United States Patent 8,030,051 (ALANINE 2,3-AMINOMUTASES AND RELATED POLYNUCLEOTIDES) - sequence listing, part 2

SEQ ID NO: 2945 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctggagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcggggggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacgagtttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagttcgataagaactaa

SEQ ID NO: 2946 - protein, 416 aa, Artificial Sequence
  Description of Artificial Sequence: Synthetic Construct
MAESRRKYYFPDVTDEQWYDWHWQVINRIKTLDQLEKYVTLTAGEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTSLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2947 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggagttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgctgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagttcgataagaactaa

SEQ ID NO: 2948 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTELLRGINDCTHVMKRLVHLLVKIRVRPYYIYACDLSLGIGHFRTPVSKGIEIIENLRGHTSGYAVPTFVVHAPGGGGKIPVTPNYAVSQSPRHVVLRNYEGVITTYTEPEDYHEECDCEDCRADKHKEGVAALSGGQQLALEPPDLARKKRKFDKN

SEQ ID NO: 2949 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacgtcgttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagttcgataagaactaa

SEQ ID NO: 2950 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTSLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2951 - DNA, 1251 bp, Artificial Sequence
  Description of Artificial Sequence: Synthetic Construct
atggcagaaagtcgtagaaagtattatctccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacgtggttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggcacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagttcgataagaactaa

SEQ ID NO: 2952 - protein, 416 aa, Artificial Sequence
  Description of Artificial Sequence: Synthetic Construct
MAESRRKYYLPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTWLLRGINDCTHVMKRLVHLLVKIRVRPYYIYACDLSLGIGHFRTPVSKGIEIIENLRGHTSGYAVPTFVAHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2953 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtagacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcagccacccgaatgaagttaccgaagaagcagtggaggcttgtgaaagaatggccaatgccggtattccgttgggtaaccaaacggtgttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaagtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagttcgataagaactaa

SEQ ID NO: 2954 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRRQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFSHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYESVITTYTEPEDYHEECDCEDCRADKHKEGVAALSGGQQLALEPPDLARKKRKFDKN

SEQ ID NO: 2955 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggggttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggttttagagcctcccgacttagctcgcaaaaaacgcaagttcgataagaactaa

SEQ ID NO: 2956 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTGLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLVLEPPDLARKKRKFDKN

SEQ ID NO: 2957 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccatccctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagaatcccgacttagctcgcaaaaaacgcaagttcgataagaactaa

SEQ ID NO: 2958 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALENPDLARKKRKFDKN

SEQ ID NO: 2959 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaaggagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaaggtgcttcttctcctcctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcgcaacctatacggagccggaggactatcatgaggagtgcgattgtgaggactgccgagccgacaagcataaagagggcgtggctgcactttccggaggtcagcagttggctttagaggagcccgacttagctcgcaaaaaacgcaagttcgataagaactaa

SEQ ID NO: 2960 - protein, 416 aa, Artificial Sequence
  Description of Artificial Sequence: Synthetic Construct
MAESRRKYYFPDVTDEQWYDWHWQVINRIKTLDQLEKYVTLTAEEGEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKGASSPPERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVIATYTEPEDYHEECDCEDCRADKHKEGVAALSGGQQLALEEPDLARKKRKFDKN

SEQ ID NO: 2961 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcattttccggaggtcagcagttggctttagagaggcccgacttagctcgcaaaaaacgcaagttcgataagaactaa

SEQ ID NO: 2962 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAAFSGGQQLALERPDLARKKRKFDKN

SEQ ID NO: 2963 - DNA, 1251 bp, Artificial Sequence; identical to SEQ ID NO: 2051
  Description of Artificial Sequence: Synthetic Construct

SEQ ID NO: 2964 - protein, 416 aa, Artificial Sequence; identical to SEQ ID NO: 2052
  Description of Artificial Sequence: Synthetic Construct

SEQ ID NO: 2965 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcatcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacgcctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagttcgataagaactaa

SEQ ID NO: 2966 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCHHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHASGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2967 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagaggcccgacttagctcgcaaaaaacgcaagttcgataagaactaa

SEQ ID NO: 2968 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALERPDLARKKRKFDKN

SEQ ID NO: 2969 - DNA, 1251 bp, Artificial Sequence
  Description of Artificial Sequence: Synthetic Construct
atggcaggaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccaacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaaacgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagttcgataagaactaa

SEQ ID NO: 2970 - protein, 416 aa, Artificial Sequence
  Description of Artificial Sequence: Synthetic Construct
MAGSRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGNEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKKRKFDKN

SEQ ID NO: 2971 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcagcccgacttagctcgcaaaaaacgcaagttcgataagaactaa

SEQ ID NO: 2972 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEQPDLARKKRKFDKN

SEQ ID NO: 2973 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccgggctgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaaaaacgcaagttcgataagaactaa

SEQ ID NO: 2974 - protein, 416 aa, Artificial Sequence; identical to SEQ ID NO: 2052
  Description of Artificial Sequence: Synthetic Construct

SEQ ID NO: 2975 - DNA, 1251 bp, Artificial Sequence
  Description of Artificial Sequence: Synthetic Construct
atggcagaaagtcgtagaaagtactatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacttatacggagccggaggactatcatgaggagtgcgattgtgaggactgccgagccgacaagcataaagagggcgtggctgcactttccggaggtcagcagttggctttagagccgcccgacttagctcgcaaaaaacgcaagttcgataagaactaa

SEQ ID NO: 2976 - protein, 416 aa, Artificial Sequence; identical to SEQ ID NO: 2052
  Description of Artificial Sequence: Synthetic Construct

SEQ ID NO: 2977 - DNA, 1251 bp, Artificial Sequence
  Description of Artificial Sequence: Synthetic Construct
atggcagaaagtcgtagaaagcattatttccctgatgtcaccgatgggcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcgttgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcatctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattaacgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatggggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 2978 - protein, 416 aa, Artificial Sequence
  Description of Artificial Sequence: Synthetic Construct
MAESRRKHYFPDVTDGQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRRCTRRRFAGQRDASSPSERIDRCIEYIANTPTVRDVLLSGGDALLVSDERLEYILKHLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEINENLRGHTSGYAVPTFVVHAPGGGGKIPVAPNYVVSQSPRHVVLRNYEGVITTYTEPEDYHGECDCEDCRVDKHREGVAALSGGQQLALEPPDLARKERRSDKN

SEQ ID NO: 2979 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcggccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgtcgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatggggagtgcgattgtgaggactgccgagccgacaagcatcgtgagggcgtggctgcactttccggaggtcagcagttggctttagagcctcccgacttagctcgcaaagaacgcaggcgcgataagaactaa

SEQ ID NO: 2980 - protein, 416 aa, Artificial Sequence
  Description of Artificial Sequence: Synthetic Construct
MAESRRKHYFPDVTDEQWYDWHWQVINRIKTLGQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHGECDCEDCRADKHREGVAALSGGQQLALEPPDLARKERRRDKN

SEQ ID NO: 2981 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgccgggaactggtacgtgctcctgaagatatggtagacccacttagtgaagatgaagattcgcccgtacccggactgactcatcgttatccggatcgtgtgttgttccttatcacggacaaatgttcgatgtactgtcgtcgttgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcatctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaacgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattaacgaaaatttgcgcggacacacctcgggctatgcagttcctacctttgtggtacatgctccggggggtggtggtaagatacctgtggcgccgaactatgttgtatctcagtccccacgacgtgtggttcttcgcaattatggaggtgttatcacaacctatacggagccggaggactatcatggggagtgcgattgtgaggactgccgagtcggcaagcatcgtgagggcgtggctgcactttccggaggtcagcagttggctttagagcctcccgacttagctcgcaaagaacgcaggagcgataggaactaa

SEQ ID NO: 2982 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRRCTRRRFAGQRDASSPSERIDRCIEYIANTPTVRDVLLSGGDALLVSDERLEYILKHLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEINENLRGHTSGYAVPTFVVHAPGGGGKIPVAPNYVVSQSPRRVVLRNYGGVITTYTEPEDYHGECDCEDCRVGKHREGVAALSGGQQLALEPPDLARKERRSDRN

SEQ ID NO: 2983 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcggccagctggagaagtacgttacactcaccgctgaagaagaagagggagtaaaagaatcgcccaaagtactccgaatggctatcacaccttattatttgagtttgatagaccccgagaatcctaattgtccgattcgtaaccaagccattcctactcgccgggaactggtacgtgctcctgaagatatggtagacccacttagtgaagatgaagattcgcccgtacccggactgactcatcgttatccggatcgtgtattgttccttatcacggacaaatgttcgatgtactgtcgtcgttgtactcgccgtcgcttcgcaggacagagagatgcttcttctccttctgagcgcatcgatcgatgcattgagtatatagccagtacaccgacagtccgcgatgttttgctatcgggaggcgatgccctccttgtcagcgacgaacgcttggaatacatattgaagcatctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttaccacaacctatacggagccggaggactatcatgaggagtgcgattgtgaggactgccgagtcgacaagcatcgtgagggcgtggctgcactttccggaggtcagcagttggctttagagccggccgacttagctcgcaaaaaacgcaggagcgataagaactaa

SEQ ID NO: 2984 - protein, 416 aa, Artificial Sequence
  Description of Artificial Sequence: Synthetic Construct
MAESRRKYYFPDVTDEQWYDWHWQVINRIKTLGQLEKYVTLTAEEEEGVKESPKVLRMAITPYYLSLIDPENPNCPIRNQAIPTRRELVRAPEDMVDPLSEDEDSPVPGLTHRYPDRVLFLITDKCSMYCRRCTRRRFAGQRDASSPSERIDRCIEYIASTPTVRDVLLSGGDALLVSDERLEYILKHLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVTTTYTEPEDYHEECDCEDCRVDKHREGVAALSGGQQLALEPADLARKKRRSDKN

SEQ ID NO: 2985 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcggccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacgggaactggtacgtgctcctgaagatatggtagacccacttagtgaagatgaagattcgcccgtacccggactgactcatcgttatccggatcgtgtattgttccttatcacggacaaatgttcgatgtactgtcgtcgttgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcatctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattaacgaaaatttgcgcggacacacctcgggctatgcagttcctacctttgtggtgcatgctccggggggtggtggtaagatacctgtggcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 2986 - protein, 416 aa, Artificial Sequence
  Description of Artificial Sequence: Synthetic Construct
MAESRRKHYFPDVTDEQWYDWHWQVINRIKTLGQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRRCTRRRFAGQRDASSPSERIDRCIEYIANTPTVRDVLLSGGDALLVSDERLEYILKHLREVPHVEIVRIGSRAPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEINENLRGHTSGYAVPTFVVHAPGGGGKIPVAPNYVVSQSPRHVVLRNYEGVITTYTEPEDYHEECDCEDCRVDKHREGVAALSGGQQLALEPPDLARKKRRSDKN

SEQ ID NO: 2987 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcggccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacgggaactggtacgtgctcctgaagatatggtagacccacttagtgaagatgaagattcgcccgtacccggactgactcatcgttatccggatcgtgtattgttccttatcacggacaaatgttcgatgtactgtcgtcgttgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtgattcttcgcaattatgaaggtgttatcacaacctatacggagccggaggactatcatggggagtgcgattgtgaggactgccgagccggcaagcatcgtgagggcgtggctgcactttccggaggtcagcagttggctttagagcctcccgacttagctcgcaaagaacgcaggagcgataagaactaa

SEQ ID NO: 2988 - protein, 416 aa, Artificial Sequence
  Description of Artificial Sequence: Synthetic Construct
MAESRRKHYFPDVTDEQWYDWHWQVINRIKTLGQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRRCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVAPNYVVSQSPRHVILRNYEGVITTYTEPEDYHGECDCEDCRAGKHREGVAALSGGQQLALEPPDLARKERRSDKN

SEQ ID NO: 2989 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacacccaccgctgaagaagaagagggagtaaaagaatcgcccaaagtactccgaatggctatcacaccttattatttgagtttgatagaccccgagaatcctaattgtccgattcgtaaacaagccattcctactcgacgggaactggtacgtgctcctgaagatatggtagacccacttagtgaagacgaagattcgcccgtacccggactgactcatcgttatccggatcgtgtattgttccttatcacggacaaatgttcgatgtactgtcgtcgttgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcatctgcgcgaagtacctcatgtggagattgttcgtataggaagccgtgcgccggtagtcctccctcagcgtataacgcctcaattggtggacatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaaggtgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatggggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 2990 - protein, 416 aa, Artificial Sequence
  Description of Artificial Sequence: Synthetic Construct
MAESRRKYYFPDVTDEQWYDWHWQVINRIKTLDQLEKYVTPTAEEEEGVKESPKVLRMAITPYYLSLIDPENPNCPIRKQAIPTRRELVRAPEDMVDPLSEDEDSPVPGLTHRYPDRVLFLITDKCSMYCRRCTRRRFAGQRDASSPSERIDRCIEYIANTPTVRDVLLSGGDALLVSDERLEYILKHLREVPHVEIVRIGSRAPVVLPQRITPQLVDMLKKYHPVWLNTHFNHPNEVTEEAVEACERMANAGIPLGNQTVLLRGINDCTHVMKRLVHLLVKVRVRPYYIYACDLSLGIGHFRTPVSKGIEIIENLRGHTSGYAVPTFVVHAPGGGGKIPVAPNYVVSQSPRHVVLRNYEGVITTYTEPEDYHGECDCEDCRVDKHREGVAALSGGQQLALEPPDLARKERRSDKN

SEQ ID NO: 2991 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcggccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgtcgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtggcgccgaactatgttgtatctcagtccccacgacatgtggttcttcgcaattatgaaggtgttatcacaacctatacggagccggaggactatcatggggagtgcgattgtgaggactgccgagtcggcaagcatcgtgagggcgtggctgcactttccggaggtcagcagttggctttagagcctcccgacttagctcgcaaagaacgcaggagcgataagaactaa

SEQ ID NO: 2992 - protein, 416 aa, Artificial Sequence
  Description of Artificial Sequence: Synthetic Construct
MAESRRKHYFPDVTDEQWYDWHWQVINRIKTLGQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHGECDCEDCRVGKHREGVAALSGGQQLALEPPDLARKERRSDKN

SEQ ID NO: 2993 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcggccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgtcgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaaggtgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtggcgccgaactatgttgtatctcagtccccacgacatgtggttcttcgcaattatgaaggtgttatcacaacctatacggagccggaggactatcatggggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 2994 - protein, 416 aa, Artificial Sequence
  Description of Artificial Sequence: Synthetic Construct
MAESRRKHYFPDVTDEQWYDWHWQVINRIKTLGQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKVRVRPYYIYACDLSLGIGHFRTPVSKGIEIIENLRGHTSGYAVPTFVVHAPGGGGKIPVAPNYVVSQSPRHVVLRNYEGVITTYTEPEDYHGECDCEDCRVDKHREGVAALSGGQQLALEPPDLARKKRRSDKN

SEQ ID NO: 2995 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgtcgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattaacgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 2996 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEINENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 2997 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcggccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgtcgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagattcgtgtgcgtccttactatatatatgcttgcgatctttcgcttggaatagggcatttccgcacgccggtatctaaaggaatcgaaattaccgaaaatttgcgcggacacacctcgggctatgcagttcctacctttgtggtacatgctccggggggtggtggtaagatacctgtggcgccgaactatgttgtatctcagtccccacgacatgtggttcttcgcaattatgaaggtgttatcacaacctatacggagccggaggactatcatgaggagtgcgattgtgaggactgccgagtcggcaagcatcgtgagggcgtggctgcactttccggaggtcaacagttggctttagagcctcccgacttagctcgcaaagaacgcaggagcgataagaactaa

SEQ ID NO: 2998 - protein, 416 aa, Artificial Sequence
  Description of Artificial Sequence: Synthetic Construct
MAESRRKHYFPDVTDEQWYDWHWQVINRIKTLGQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEITENLRGHTSGYAVPTFVVHAPGGGGKIPVAPNYVVSQSPRHVVLRNYEGVITTYTEPEDYHEECDCEDCRVGKHREGVAALSGGQQLALEPPDLARKERRSDKN

SEQ ID NO: 2999 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcggccagctggagaagtacgttacactcaccgctgaagaagaagagggagtaaaagaatcgcccaaagtactccgaatggctatcacaccttattacttgagtttgatagaccccgagaatcctaattgtccgattcgtaaacaagccattcctactcgtcgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcatctgcgcgaagtacctcatgtggagactgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattaccgaaaatttgcgcggacacacctcgggctatgcagttcctacctttgtggtacatgctccggggggtggtggtaagatacctgtggcgccgaactatgttgtatctcagtccccacgacatgtggttcttcgcaattatgaaggtgttatcacaacctatacggagccggaggactatcatgaggagtgcgattgtgaggactgccgagccggcaagcatcgtgagggcgtggctgcactttccggaggtcagcagttggctttagagcctcccgacttagctcgcaaagaacgcaggagcgataggaactaa

SEQ ID NO: 3000 - protein, 416 aa, Artificial Sequence
  Description of Artificial Sequence: Synthetic Construct
MAESRRKHYFPDVTDEQWYDWHWQVINRIKTLGQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKHLREVPHVETVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEITENLRGHTSGYAVPTFVVHAPGGGGKIPVAPNYVVSQSPRHVVLRNYEGVITTYTEPEDYHEECDCEDCRAGKHREGVAALSGGQQLALEPPDLARKERRSDRN

SEQ ID NO: 3001 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcggccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattaccgaaaatttgcgcggacacacctcgggctatgcagttcctacctttgtggtacatgctccggggggtggtggtaagatacctgtagcgccgaactatgttgtatctcagtccccacgacgtgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataggaactaa

SEQ ID NO: 3002 - protein, 416 aa, Artificial Sequence
  Description of Artificial Sequence: Synthetic Construct
MAESRRKHYFPDVTDEQWYDWHWQVINRIKTLGQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEITENLRGHTSGYAVPTFVVHAPGGGGKIPVAPNYVVSQSPRRVVLRNYEGVITTYTEPEDYHEECDCEDCRVDKHREGVAALSGGQQLALEPPDLARKERRSDRN

SEQ ID NO: 3003 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgccgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaaggtgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtggcgccgaactatgttgtatctcagtccccacgacatgtggttcttcgcaattatgaaggtgttatcacaacctatacggagccggaggactatcatggggagtgcgattgtgaggactgccgagccgacaagcatcgtgagggcgtggctgcactttccggaggtcagcagttggctttagagcctcccgacttagctcgcaaagaacgcaggagcgataggaactaa

SEQ ID NO: 3004 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKVRVRPYYIYACDLSLGIGHFRTPVSKGIEIIENLRGHTSGYAVPTFVVHAPGGGGKIPVAPNYVVSQSPRHVVLRNYEGVITTYTEPEDYHGECDCEDCRADKHREGVAALSGGQQLALEPPDLARKERRSDRN

SEQ ID NO: 3005 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcatctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaggagattggtacatttgctggtaaagattcgtgtgcgtccttactatatatatgcttgcgatctttcgcttggaatagggcatttccgcacgccggtatctaaaggaatcgaaattaccgaaaatttgcgcggacacacctcgggctatgcagttcctacctttgtggtacatgctccggggggtggtggtaagatacctgtggcgccgaactatgttgtatctcagtccccacgacatgtggttcttcgcaattatgaaggtgttatcacaacctatacggagccggaggactatcatgaggagtgcgattgtgaggactgccgagtcggcaagcatcgtgagggcgtggctgcactttccggaggtcagcagttggctttagagcctcccgacttagctcgcaaagaacgcaggagcgataagaactaa

SEQ ID NO: 3006 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKHLREVPHVEIVRIGSRAPVVLPQRITPQLVDMLKKYHPVWLNTHFNHPNEVTEEAVEACERMANAGIPLGNQTVLLRGINDCTHVMRRLVHLLVKIRVRPYYIYACDLSLGIGHFRTPVSKGIEITENLRGHTSGYAVPTFVVHAPGGGGKIPVAPNYVVSQSPRHVVLRNYEGVITTYTEPEDYHEECDCEDCRVGKHREGVAALSGGQQLALEPPDLARKERRSDKN

SEQ ID NO: 3007 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgccgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaaggtgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacgtgtggttcttcgcaattatgaaggtgttatcacaacctatacggagccggaggactatcatggggagtgcgattgtgaggactgccgagtcgacaagcatcgtgagggcgtggctgcactttccggaggtcagcagttggctttagagcctcccgacttagctcgcaaagaacgcaggagcgataggaactaa

SEQ ID NO: 3008 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKVRVRPYYIYACDLSLGIGHFRTPVSKGIEIIENLRGHTSGYAVPTFVVHAPGGGGKIPVAPNYVVSQSPRRVVLRNYEGVITTYTEPEDYHGECDCEDCRVDKHREGVAALSGGQQLALEPPDLARKERRSDRN

SEQ ID NO: 3009 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacgggaactggtacgtgctcctgaagatatggtagacccacttagtgaagatgaagattcgcccgtacccggactgactcatcgttatccggatcgtgtattgttccttatcacggacaaatgttcgatgtactgtcgtcgttgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattaccgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagccggcaagcatcgtgagggcgtggctgcactttccggaggtcagcagttggctttagagcctcccgacttagctcgcaaagaacgcaggagcgataggaactaa

SEQ ID NO: 3010 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRRCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEITENLRGHTSGYAVPTFVVHAPGGGGKIPVAPNYVVSQSPRHVVLRNYEGVITTYTEPEDYHEECDCEDCRAGKHREGVAALSGGQQLALEPPDLARKERRSDRN

SEQ ID NO: 3011 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcggccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgccgggaactggtacgtgctcctgaagatatggtagacccacttagtgaagatgaagattcgcccgtacccggactgactcatcgttatccggatcgtgtattgttccttatcacggacaaatgttcgatgtactgtcgtcgttgtactcgccgtcgcttcgcaggacagagagatgcttcttctccttctgagcgcatcgatcgatgcattgagtgtatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtatgacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagattcgtgtgcgtccttactatatatatgcttgcgatctttcgcttggaatagggcatttccgcacgccggtatctaaaggaatcgaaattaccgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagccgacaagcatcgtgagggcgtggctgcactttccggaggtcagcagttggctttagagcctcccgacttagctcgcaaagaacgcaggagcgataagaactaa

SEQ ID NO: 3012 - protein, 416 aa, Artificial Sequence
  Description of Artificial Sequence: Synthetic Construct
MAESRRKHYFPDVTDEQWYDWHWQVINRIKTLGQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRRCTRRRFAGQRDASSPSERIDRCIECIANTPTVRDVLLSGGDALLVSDERLEYILKRLREVPHVEIVRIGSRAPVVLPQRMTPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEITENLRGHTSGYAVPTFVVHAPGGGGKIPVAPNYVVSQSPRHVVLRNYEGVITTYTEPEDYHEECDCEDCRADKHREGVAALSGGQQLALEPPDLARKERRSDKN

SEQ ID NO: 3013 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcatctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtggcgccgaactatgttgtatctcagtccccacgacgtgtggttcttcgcaattatgaaggtgttatcacaacctatacggagccggaggactatcatggggagtgcgattgtgaggactgccgagtcgacaagcatcgtgagggcgtggctgcactttccggaggtcagcagttggctttagagcctcccgacttagctcgcaaagaacgcaggagcgataggaactaa

SEQ ID NO: 3014 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKHLREVPHVEIVRIGSRAPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVAPNYVVSQSPRRVVLRNYEGVITTYTEPEDYHGECDCEDCRVDKHREGVAALSGGQQLALEPPDLARKERRSDRN

SEQ ID NO: 3015 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcggccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgtcgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcatctgcgcgaagtacctcatgtggagattgttcgtataggaagccgtgcgccggtagtccaccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattaccgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3016 - protein, 416 aa, Artificial Sequence
  Description of Artificial Sequence: Synthetic Construct
MAESRRKHYFPDVTDEQWYDWHWQVINRIKTLGQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKHLREVPHVEIVRIGSRAPVVHPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEITENLRGHTSGYAVPTFVVHAPGGGGKIPVAPNYVVSQSPRHVVLRNYEGVITTYTEPEDYHEECDCEDCRVDKHREGVAALSGGQQLALEPPDLARKKRRSDKN

SEQ ID NO: 3017 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcggccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacgggaactggtacgtgctcctgaagatatggtagacccacttagtgaagatgaagattcgcccgtacccggactgactcatcgttatccggatcgtgtattgttccttatcacggacaaatgttcgatgtactgtcgtcgttgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcatctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggcctatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattaacgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatggggagtgcgattgtgaggactgccgagccgacaagcatcgtgagggcgtggctgcactttccggaggtcagcagttggctttagagcctcccgacttagctcgcaaagaacgcaggagcgataggaactaa

SEQ ID NO: 3018 - protein, 416 aa, Artificial Sequence
  Description of Artificial Sequence: Synthetic Construct
MAESRRKHYFPDVTDEQWYDWHWQVINRIKTLGQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRRCTRRRFAGQRDASSPSERIDRCIEYIANTPTVRDVLLSGGDALLVSDERLEYILKHLREVPHVEIVRIGSRAPVVLPQRITPQLVDMLKKYHPVWLNTHFNHPNEVTEEAVEACERMAYAGIPLGNQTVLLRGINDCTHVMKRLVHLLVKIRVRPYYIYACDLSLGIGHFRTPVSKGIEINENLRGHTSGYAVPTFVVHAPGGGGKIPVAPNYVVSQSPRHVVLRNYEGVITTYTEPEDYHGECDCEDCRADKHREGVAALSGGQQLALEPPDLARKERRSDRN

SEQ ID NO: 3019 - DNA, 1251 bp, Artificial Sequence
  Description of Artificial Sequence: Synthetic Construct
atggcagaaagtcgtagaaagtattatttccctgatgtcaccaatgagcaatggtacgactggcattggcaggtcatcaatcgaattaggacgctcgaccagctggagaagtacgttacactcaccgctgaggaagaagagggagtaaaagaatcgcccaaagtactccgaatggctatcacaccttattatttgagtttgataaaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcggagtacctcatgtggagattgttcgtataggaagccgtgcgccggtagtcctccctcagcgtatgacgcctcgattggtggatatgctcaaaaaatatcatccggtgtggctgaacactcacttcaaccacccgaatgaagttaccgaagaagcagtgggggcttgtgaaagaatggccaatgccggtattccgttgggtaaccaaacggttttattgcgtggaatcaatggttgtacacatgtgatgaagagattggtacatttgctggtaaagattcgtgtgcgtccttactatatatatgcttgcgatctttcgcttggaatagggcatttccgcacgccgatatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3020 - protein, 416 aa, Artificial Sequence
  Description of Artificial Sequence: Synthetic Construct
MAESRRKYYFPDVTNEQWYDWHWQVINRIRTLDQLEKYVTLTAEEEEGVKESPKVLRMAITPYYLSLINPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLRGVPHVEIVRIGSRAPVVLPQRMTPRLVDMLKKYHPVWLNTHFNHPNEVTEEAVGACERMANAGIPLGNQTVLLRGINGCTHVMKRLVHLLVKIRVRPYYIYACDLSLGIGHFRTPISKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKKRRSDKN

SEQ ID NO: 3021 - DNA, 1251 bp, Artificial Sequence
  Description of Artificial Sequence: Synthetic Construct
atggcagaaagtcgtagaaagtattatttccctgatgtcaccaatgagcaatggtacgactggcattggcaggtcatcaatcgaattaggacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcggagtacctcatgtggagattgttcgtataggaagccgtgcgccggtagtcctccctcagcgtatgacgcctcaattggtggatatgctcaaaaaatatcatccggtgtggctgaacactcacttcaaccacccgaatgaagttaccgaagaagcagtgggggcttgtgaaagaatggccaatgccggtattccattgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccgatatcaaaaggaatcgaaattatcgaaaatttgcgcggacacacctcgggctatgcagttcctacctttgcggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctacactttccggaggtcagcagttggctttagagcctcccgacttagctcgcaaaaaacacaggagcgataagaactaa

SEQ ID NO: 3022 - protein, 416 aa, Artificial Sequence
  Description of Artificial Sequence: Synthetic Construct
MAESRRKYYFPDVTNEQWYDWHWQVINRIRTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLRGVPHVEIVRIGSRAPVVLPQRMTPQLVDMLKKYHPVWLNTHFNHPNEVTEEAVGACERMANAGIPLGNQTVLLRGINDCTHVMKRLVHLLVKIRVRPYYIYACDLSLGIGHFRTPISKGIEIIENLRGHTSGYAVPTFAVHAPGGGGKIPVAPNYVVSQSPRHVVLRNYEGVITTYTEPEDYHEECDCEDCRVDKHREGVATLSGGQQLALEPPDLARKKHRSDKN

SEQ ID NO: 3023 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctggggaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtggaggaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctacactttccggaggtcagcagttggttttagagcctcccgacttagctcgcaaaaaacgcaggagcgataagaactaa

SEQ ID NO: 3024 - protein, 416 aa, Artificial Sequence
  Description of Artificial Sequence: Synthetic Construct
MAESRRKYYFPDVTDEQWYDWHWQVINRIKTLDQLEKYVTLTAGEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACGGMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVATLSGGQQLVLEPPDLARKKRRSDKN

SEQ ID NO: 3025 - DNA, 1251 bp, Artificial Sequence
  Description of Artificial Sequence: Synthetic Construct
atggcagaaagtcgtagaaagtattatttccctgatgtcaccaatgagcaatggtgcgactggcattggcaggtcatcaatcgaattaagacgctcgaccagctggagaagtacgttacactcaccgctggggaagaagggggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcggagtacctcatgtggagattgttcgtataggaagccgtgcgccggtagtcctccctcagcgtataacgcctcgattggtggatatgctcaaaaaatatcatccggtgtggctgaacactcacttcaaccacccgaatgaagttaccgaagaagcagtgggggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccgatatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctacactttccggaggtcagcagttggctttagagcctcccgacttagctcgcaaaaaacgcaggagcgataggaactaa

SEQ ID NO: 3026 - protein, 416 aa, Artificial Sequence
  Description of Artificial Sequence: Synthetic Construct
MAESRRKYYFPDVTNEQWCDWHWQVINRIKTLDQLEKYVTLTAGEEGGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLRGVPHVEIVRIGSRAPVVLPQRITPRLVDMLKKYHPVWLNTHFNHPNEVTEEAVGACERMANAGIPLGNQTVLLRGINDCTHVMKRLVHLLVKIRVRPYYIYACDLSLGIGHFRTPISKGIEIIENLRGHTSGYAVPTFVVHAPGGGGKIPVAPNYVVSQSPRHVVLRNYEGVITTYTEPEDYHEECDCEDCRVDKHREGVATLSGGQQLALEPPDLARKKRRSDRN

SEQ ID NO: 3027 - DNA, 1251 bp, Artificial Sequence
  Description of Artificial Sequence: Synthetic Construct
atggcagaaagtcgtagaaagtattatttccctgatgtcaccgatgagcaatggtgcgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgataaaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtgggggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccgatatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctacactttccggaggtcagcagttggttttagagcctcccgacttagctcgcaaaaaacgcaggagcgataagaactaa

SEQ ID NO: 3028 - protein, 416 aa, Artificial Sequence
  Description of Artificial Sequence: Synthetic Construct
MAESRRKYYFPDVTDEQWCDWHWQVINRIKTLDQLEKYVTLTAEEEEGVKESPKVLRMAITPYYLSLINPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVGACERMANAGIPLGNQTVLLRGINDCTHVMKRLVHLLVKIRVRPYYIYACDLSLGIGHFRTPISKGIEIIENLRGHTSGYAVPTFVVHAPGGGGKIPVAPNYVVSQSPRHVVLRNYEGVITTYTEPEDYHEECDCEDCRVDKHREGVATLSGGQQLVLEPPDLARKKRRSDKN

SEQ ID NO: 3029 - DNA, 1251 bp, Artificial Sequence
  Description of Artificial Sequence: Synthetic Construct
atggcagaaagtcgtagaaagtattatttccctgatgtcaccaatgagcaatggtacgactggcattggcaggtcatcaatcgaattaggacgctcgaccagctggagaagtacgttacactcaccgctgaagaagaagagggagtaaaagaatcgcccaaagtactccgaatggctatcacaccttattatttgagtttgataaaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcggagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtggaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccgatatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgaactttccggaggtcagcagttggctttagagcctcccgacttagctcgcaaaaaacgcaggagcgataagaactaa

SEQ ID NO: 3030 - protein, 416 aa, Artificial Sequence
  Description of Artificial Sequence: Synthetic Construct
MAESRRKYYFPDVTNEQWYDWHWQVINRIRTLDQLEKYVTLTAEEEEGVKESPKVLRMAITPYYLSLINPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLRGVPHVEIVRIGSRAPVVLPQRITPQLVDMLKKYHPVWLNTHFNHPNEVTEEAVEACGRMANAGIPLGNQTVLLRGINDCTHVMKRLVHLLVKIRVRPYYIYACDLSLGIGHFRTPISKGIEIIENLRGHTSGYAVPTFVVHAPGGGGKIPVAPNYVVSQSPRHVVLRNYEGVITTYTEPEDYHEECDCEDCRVDKHREGVAELSGGQQLALEPPDLARKKRRSDKN

SEQ ID NO: 3031 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaggacgctcgaccagctggagaagtacgttacactcaccgctgaagaagaagagggagtaaaagaatcgcccaaagtactccgaatggctatcacaccttattatttgagtttgataaaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtatgacgcctcgattggtggatatgctcaaaaaatatcatccggtgtggctgaacactcacttcaaccacccgaatgaagttaccgaagaagcagtgggggcttgtggaagaatggccaatgccggtattccgttgggtaaccaaacggttttattgcgtggaatcaatggttgtacacatgtgatgaagagattggtacatttgctggtaaagattcgtgtgcgtccttactatatatatgcttgcgatctttcgcttggaatagggcatttccgcacgccgatatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgaactttccggaggtcagcagttggctttagagcctcccgacttagctcgcaaaaaacgcaggagcgataagaactaa

SEQ ID NO: 3032 - protein, 416 aa, Artificial Sequence
  Description of Artificial Sequence: Synthetic Construct
MAESRRKYYFPDVTDEQWYDWHWQVINRIRTLDQLEKYVTLTAEEEEGVKESPKVLRMAITPYYLSLINPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRMTPRLVDMLKKYHPVWLNTHFNHPNEVTEEAVGACGRMANAGIPLGNQTVLLRGINGCTHVMKRLVHLLVKIRVRPYYIYACDLSLGIGHFRTPISKGIEIIENLRGHTSGYAVPTFVVHAPGGGGKIPVAPNYVVSQSPRHVVLRNYEGVITTYTEPEDYHEECDCEDCRVDKHREGVAELSGGQQLALEPPDLARKKRRSDKN

SEQ ID NO: 3033 - DNA, 1251 bp, Artificial Sequence
  Description of Artificial Sequence: Synthetic Construct
atggcagaaagtcgtagaatgtattatttccctgatgtcaccgatgagcaatggtacgactggcattggcaggtcatcaatcgaattaggacgctcgaccagctggagaagtacgttacactcaccgctggggaagaagggggagtaaaagaatcgcccaaagtactccgaatggctatcacaccttattatttgagtttgataaaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcggagtacctcatgtggagattgctcgtataggaagccgtgcgccggtagtcctccctcagcgtatgacgcctcgattggtggatatgctcaaaaaatatcatccggtgtggctgaacactcacttcaaccacccgaatgaagttaccgaagaagcagtgggggcttgtgaaggaatggccaatgccggtattccgttgggtaaccaaacggttttattgcgtggaatcaatggttgtacacatgtgatgaagagattggtacatttgctggtaaagattcgtgtgcgtccttactatatatatgcttgcgatctttcgcttggaatagggcatttccgcacgccgatatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggttttagagcctcccgacttagctcgcaaaaaacgcaggagcgataagaactaa

SEQ ID NO: 3034 - protein, 416 aa, Artificial Sequence
  Description of Artificial Sequence: Synthetic Construct
MAESRRMYYFPDVTDEQWYDWHWQVINRIRTLDQLEKYVTLTAGEEGGVKESPKVLRMAITPYYLSLINPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLRGVPHVEIARIGSRAPVVLPQRMTPRLVDMLKKYHPVWLNTHFNHPNEVTEEAVGACEGMANAGIPLGNQTVLLRGINGCTHVMKRLVHLLVKIRVRPYYIYACDLSLGIGHFRTPISKGIEIIENLRGHTSGYAVPTFVVHAPGGGGKIPVAPNYVVSQSPRHVVLRNYEGVITTYTEPEDYHEECDCEDCRVDKHREGVAALSGGQQLVLEPPDLARKKRRSDKN

SEQ ID NO: 3035 - DNA, 1251 bp, Artificial Sequence
  Description of Artificial Sequence: Synthetic Construct
atggcagaaagtcgtagaaagtattatttccctgatgtcaccgatgagcaatggtgcgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgataaaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcggagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtggaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccgatatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3036 - protein, 416 aa, Artificial Sequence
  Description of Artificial Sequence: Synthetic Construct
MAESRRKYYFPDVTDEQWCDWHWQVINRIKTLDQLEKYVTLTAEEEEGVKESPKVLRMAITPYYLSLINPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLRGVPHVEIVRIGSRAPVVLPQRITPQLVDMLKKYHPVWLNTHFNHPNEVTEEAVEACGRMANAGIPLGNQTVLLRGINDCTHVMKRLVHLLVKIRVRPYYIYACDLSLGIGHFRTPISKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKKRRSDKN

SEQ ID NO: 3037 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcggagtacctcatgtggagattgttcgtataggaagccgtgcgccggtagtcctccctcagcgtatgacgcctcgattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccgatatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctacactttccggaggtcagcagttggctttagagcctcccgacttagctcgcaaaaaacgcaggagcgataagaactaa

SEQ ID NO: 3038 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLRGVPHVEIVRIGSRAPVVLPQRMTPRLVDMLKKYHPVWLNTHFNHPNEVTEEAVEACERMANAGIPLGNQTVLLRGINDCTHVMKRLVHLLVKIRVRPYYIYACDLSLGIGHFRTPISKGIEIIENLRGHTSGYAVPTFVVHAPGGGGKIPVAPNYVVSQSPRHVVLRNYEGVITTYTEPEDYHEECDCEDCRVDKHREGVATLSGGQQLALEPPDLARKKRRSDKN

SEQ ID NO: 3039 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaggagtacgttacactcaccgctgaagaagaagagggagtaaaagaatcgcccaaagtactccgaatggctatcacaccttattatttgagtttgataaaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcggagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatggttgtacacatgtgatgaagagattggtacatttgctggtaaagattcgtgtgcgtccttactatatatatgcttgcgatctttcgcttggaatagggcatttccgcacgccgatatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggttttagagcctcccgacttagctcgcaaaaaacgcaggagcgataagaactaa

SEQ ID NO: 3040 - protein, 416 aa, Artificial Sequence
  Description of Artificial Sequence: Synthetic Construct
MAESRRKYYFPDVTDEQWYDWHWQVINRIKTLDQLEEYVTLTAEEEEGVKESPKVLRMAITPYYLSLINPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLRGVPHVEIVRIGSRAPVVLPQRITPQLVDMLKKYHPVWLNTHFNHPNEVTEEAVEACERMANAGIPLGNQTVLLRGINGCTHVMKRLVHLLVKIRVRPYYIYACDLSLGIGHFRTPISKGIEIIENLRGHTSGYAVPTFVVHAPGGGGKIPVAPNYVVSQSPRHVVLRNYEGVITTYTEPEDYHEECDCEDCRVDKHREGVAALSGGQQLVLEPPDLARKKRRSDKN

SEQ ID NO: 3041 - DNA, 1251 bp, Artificial Sequence
  Description of Artificial Sequence: Synthetic Construct
atggcagaaagtcgtagaaagtattatttccctgatgtcaccaatgagcaatggtacgactggcattggcaggtcatcaatcgaattaagacgctcgaccagctggagaagtacgttacactcaccgctgaggaagaagggggagtaaaagaatcgcccaaagtactccgaatggctatcacaccttattatttgagtttgataaaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcgattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatggttgtacacatgtgatgaagagattggtacatttgctggtaaagattcgtgtgcgtccttactatatatatgcttgcgatctttcgcttggaatagggcatttccgcacgccgatatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgaactttccggaggtcagcagttggctttagagcctcccgacttagctcgcaaaaaacgcaggagcgataagaactaa

SEQ ID NO: 3042 - protein, 416 aa, Artificial Sequence
  Description of Artificial Sequence: Synthetic Construct
MAESRRKYYFPDVTNEQWYDWHWQVINRIKTLDQLEKYVTLTAEEEGGVKESPKVLRMAITPYYLSLINPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPRLVDMLKKYHPVWLNTHFNHPNEVTEEAVEACERMANAGIPLGNQTVLLRGINGCTHVMKRLVHLLVKIRVRPYYIYACDLSLGIGHFRTPISKGIEIIENLRGHTSGYAVPTFVVHAPGGGGKIPVAPNYVVSQSPRHVVLRNYEGVITTYTEPEDYHEECDCEDCRVDKHREGVAELSGGQQLALEPPDLARKKRRSDKN

SEQ ID NO: 3043 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaggacgctcgaccagctggagaagtacgttacactcaccgctgaagaagaagagggagtaaaagaatcgcccaaagtactccgaatggctatcacaccttattatttgagtttgataaaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcggagtacctcatgtggagattgttcgtataggaagccgtgcgccggtagtcctccctcagcgtatgacgcctcgattggtggatatgctcaaaaaatatcatccggtgtggctgaacacttacttcaaccacccgaatgaagttaccgaagaagcagtggaggcttgtggaggaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccgatatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgaactttccggaggtcagcagttggctttagagcctcccgacttagctcgcaaaaaacgcaggagcgataagaactaa

SEQ ID NO: 3044 - protein, 416 aa, Artificial Sequence
  Description of Artificial Sequence: Synthetic Construct
MAESRRKYYFPDVTDEQWYDWHWQVINRIRTLDQLEKYVTLTAEEEEGVKESPKVLRMAITPYYLSLINPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLRGVPHVEIVRIGSRAPVVLPQRMTPRLVDMLKKYHPVWLNTYFNHPNEVTEEAVEACGGMANAGIPLGNQTVLLRGINDCTHVMKRLVHLLVKIRVRPYYIYACDLSLGIGHFRTPISKGIEIIENLRGHTSGYAVPTFVVHAPGGGGKIPVAPNYVVSQSPRHVVLRNYEGVITTYTEPEDYHEECDCEDCRVDKHREGVAELSGGQQLALEPPDLARKKRRSDKN

SEQ ID NO: 3045 - DNA, 1251 bp, Artificial Sequence
  Description of Artificial Sequence: Synthetic Construct
atggcagaaagtcgtagaaagtattatttccctgatgtcaccgatgagcaatggtgcgactggcattggcaggtcatcaatcgaattaagacgctcgaccagctggagaagtacgttacactcaccgctgaggaagaagagggagtaaaagaatcgcccaaagtactccgaatggctatcacaccttattatttgagtttgataaaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgacgcagtgagtatatagccaatacaccgacagtccgcgatgttttgctatcgggaggcgatgccctccttgtcagcgacgaacgcttggaatacatattgaagcgtctgcgcggagtacctcatgtggagattgttcgtataggaagccgtgcgccggtagtcctccctcagcgtatgacgcctcgattggtggatatgctcaaaaaatatcatccggtgtggctgaacactcacttcaaccacccgaatgaagttaccgaagaagcagtggaggcttgtgaaagaatggccaatgccggtatcccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccgatatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggttttagagcctcccgacttagctcgcaaaaaacgcaggagcgataagaactaa

SEQ ID NO: 3046 - protein, 416 aa, Artificial Sequence
  Description of Artificial Sequence: Synthetic Construct
MAESRRKYYFPDVTDEQWCDWHWQVINRIKTLDQLEKYVTLTAEEEEGVKESPKVLRMAITPYYLSLINPENPNCPIRKQAIPTKRELVRAPEDMVDPLSEDEDSPVPGLTHRYPDRVLFLITDKCSMYCRHCTRRRFAGQRDASSPSERIDRRSEYIANTPTVRDVLLSGGDALLVSDERLEYILKRLRGVPHVEIVRIGSRAPVVLPQRMTPRLVDMLKKYHPVWLNTHFNHPNEVTEEAVEACERMANAGIPLGNQTVLLRGINDCTHVMKRLVHLLVKIRVRPYYIYACDLSLGIGHFRTPISKGIEIIENLRGHTSGYAVPTFVVHAPGGGGKIPVAPNYVVSQSPRHVVLRNYEGVITTYTEPEDYHEECDCEDCRVDKHREGVAALSGGQQLVLEPPDLARKKRRSDKN

SEQ ID NO: 3047 - DNA, 1251 bp, Artificial Sequence
  Description of Artificial Sequence: Synthetic Construct
atggcagaaagtcgtagaaagtattatttccctgatgtcaccgatgagcaatggtgcgactggcattggcaggtcatcaatcgaattaagacgctcgaccagctggagaagtacgttacactcaccgctgaggaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaggatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtatgacgcctcgattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccgatatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctacactttccggaggtcagcagttggttttagagcctcccgacttagctcgcaaaaaacgcaggagcgataagaactaa

SEQ ID NO: 3048 - protein, 416 aa, Artificial Sequence
  Description of Artificial Sequence: Synthetic Construct
MAESRRKYYFPDVTDEQWCDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRMTPRLVDMLKKYHPVWLNTHFNHPNEVTEEAVEACERMANAGIPLGNQTVLLRGINDCTHVMKRLVHLLVKIRVRPYYIYACDLSLGIGHFRTPISKGIEIIENLRGHTSGYAVPTFVVHAPGGGGKIPVAPNYVVSQSPRHVVLRNYEGVITTYTEPEDYHEECDCEDCRVDKHREGVATLSGGQQLVLEPPDLARKKRRSDKN

SEQ ID NO: 3049 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgataaaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcggagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtggaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccgatatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctacactttccggaggtcagcagttggctttagagcctcccgacttagctcgcaaaaaacgcaggagcgataagaactaa

SEQ ID NO: 3050 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLINPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLRGVPHVEIVRIGSRAPVVLPQRITPQLVDMLKKYHPVWLNTHFNHPNEVTEEAVEACGRMANAGIPLGNQTVLLRGINDCTHVMKRLVHLLVKIRVRPYYIYACDLSLGIGHFRTPISKGIEIIENLRGHTSGYAVPTFVVHAPGGGGKIPVAPNYVVSQSPRHVVLRNYEGVITTYTEPEDYHEECDCEDCRVDKHREGVATLSGGQQLALEPPDLARKKRRSDKN

SEQ ID NO: 3051 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaggacgctcgaccagctggagaagtacgttgcactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgagcgcttggaatacatattgaagcgtctgcgcggagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtgggggcttgtggaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccgatatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgaactttccggaggtcagcagttggctttagagcctcccgacttagctcgcaaaaaacgcaggagcgataagaactaa

SEQ ID NO: 3052 - protein, 416 aa, Artificial Sequence
  Description of Artificial Sequence: Synthetic Construct
MAESRRKYYFPDVTDEQWYDWHWQVINRIRTLDQLEKYVALTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLRGVPHVEIVRIGSRAPVVLPQRITPQLVDMLKKYHPVWLNTHFNHPNEVTEEAVGACGRMANAGIPLGNQTVLLRGINDCTHVMKRLVHLLVKIRVRPYYIYACDLSLGIGHFRTPISKGIEIIENLRGHTSGYAVPTFVVHAPGGGGKIPVAPNYVVSQSPRHVVLRNYEGVITTYTEPEDYHEECDCEDCRVDKHREGVAELSGGQQLALEPPDLARKKRRSDKN

SEQ ID NO: 3053 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgataaaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcggagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtgggggcttgtggaggaatggccaatgccggtattccgttgggtaaccaaacggttttattgcgtggaatcaatggttgtacacatgtgatgaagagattggtacatttgctggtaaagattcgtgtgcgtccttactatatatatgcttgcgatctttcgcttggaatagggcatttccgcacgccgatatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3054 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLINPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLRGVPHVEIVRIGSRAPVVLPQRITPQLVDMLKKYHPVWLNTHFNHPNEVTEEAVGACGGMANAGIPLGNQTVLLRGINGCTHVMKRLVHLLVKIRVRPYYIYACDLSLGIGHFRTPISKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKKRRSDKN

SEQ ID NO: 3055 - DNA, 1251 bp, Artificial Sequence
  Description of Artificial Sequence: Synthetic Construct
atggcagaaagtcgtagaaagtattatttccctgatgtcaccgatgagcaatggtgcgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgataaaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgtatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatggttgtacacatgtgatgaagagattggtacatttgctggtaaagattcgtgtgcgtccttactatatatatgcttgcgatctttcgcttggaatagggcatttccgcacgccgatatctaaaggaatcgaagttatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgaactttccggaggtcagcagttggttttagagcctcccgacttagctcgcaaaaaacgcaggagcgataagaactaa

SEQ ID NO: 3056 - protein, 416 aa, Artificial Sequence
  Description of Artificial Sequence: Synthetic Construct
MAESRRKYYFPDVTDEQWCDWHWQVINRIKTLDQLEKYVTLTAEEEEGVKESPKVLRMAITPYYLSLINPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINGCTHVMKRLVHLLVKIRVRPYYIYACDLSLGIGHFRTPISKGIEVIENLRGHTSGYAVPTFVVHAPGGGGKIPVAPNYVVSQSPRHVVLRNYEGVITTYTEPEDYHEECDCEDCRVDKHREGVAELSGGQQLVLEPPDLARKKRRSDKN

SEQ ID NO: 3057 - DNA, 1251 bp, Artificial Sequence
  Description of Artificial Sequence: Synthetic Construct
atggcagaaagtcgtagaaagtattatttccctgatgtcaccaatgagcaatggtacgactggcattggcaggtcatcaatcgaattaggacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatcccgtgtggctgaacactcacttcaaccacccgaatgaagttaccgaagaagcagtgggggcttgtggaagaatggccaatgccggtattccgttgggtaaccaaacggttttattgcgtggaatcaatggttgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgaactttccggaggtcagcagttggctttagagcctcccgacttagctcgcaaaaaacgcaggagcgataagaactaa

SEQ ID NO: 3058 - protein, 416 aa, Artificial Sequence
  Description of Artificial Sequence: Synthetic Construct
MAESRRKYYFPDVTNEQWYDWHWQVINRIRTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVGACGRMANAGIPLGNQTVLLRGINGCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAELSGGQQLALEPPDLARKKRRSDKN

SEQ ID NO: 3059 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctggggaagaagggggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcggagtacctcatgtggagattgttcgtataggaagccgtgcgccggtagtcctccctcagcgtataacgcctcgattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccgatatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3060 - protein, 416 aa, Artificial Sequence
  Description of Artificial Sequence: Synthetic Construct
MAESRRKYYFPDVTDEQWYDWHWQVINRIKTLDQLEKYVTLTAGEEGGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLRGVPHVEIVRIGSRAPVVLPQRITPRLVDMLKKYHPVWLNTHFNHPNEVTEEAVEACERMANAGIPLGNQTVLLRGINDCTHVMKRLVHLLVKIRVRPYYIYACDLSLGIGHFRTPISKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKKRRSDKN

SEQ ID NO: 3061 - DNA, 1251 bp, Artificial Sequence
  Description of Artificial Sequence: Synthetic Construct
atggcagaaagtcgtagaaagtattatttccctgatgtcaccgatgagcaatggtgcgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcggagtacctcatgtggagattgttcgtataggaagccgtgcgccggtagtcctccctcagcgtataacgcctcgattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccgatatctaaaggaatcgaaattatcgaaaatttgcgcggacacacctcgggctatgcagttcctacctttgtggtgcatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgaactttccggaggtcagcggttggctttagagcctcccgacttagctcgcaaaaaacgcaggagcgataagagctaa

SEQ ID NO: 3062 - protein, 416 aa, Artificial Sequence
  Description of Artificial Sequence: Synthetic Construct
MAESRRKYYFPDVTDEQWCDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLRGVPHVEIVRIGSRAPVVLPQRITPRLVDMLKKYHPVWLNTHFNHPNEVTEEAVEACERMANAGIPLGNQTVLLRGINDCTHVMKRLVHLLVKIRVRPYYIYACDLSLGIGHFRTPISKGIEIIENLRGHTSGYAVPTFVVHAPGGGGKIPVAPNYVVSQSPRHVVLRNYEGVITTYTEPEDYHEECDCEDCRVDKHREGVAELSGGQRLALEPPDLARKKRRSDKS

SEQ ID NO: 3063 - DNA, 1251 bp, Artificial Sequence
  Description of Artificial Sequence: Synthetic Construct
atggcagaaagtcgtagaaagtattatttccctgatgtcaccaatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcggagtacctcatgtggagattgttcgtataggaagccgtgcgccggtagtcctccctcagcgtatgacgcctcgattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatggttgtacacatgtgatgaagagattggtacatttgctggtaaagattcgtgtgcgtccttactatatatatgcttgcgatctttcgcttggaatagggcatttccgcacgccgatatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3064 - protein, 416 aa, Artificial Sequence
  Description of Artificial Sequence: Synthetic Construct
MAESRRKYYFPDVTNEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLRGVPHVEIVRIGSRAPVVLPQRMTPRLVDMLKKYHPVWLNTHFNHPNEVTEEAVEACERMANAGIPLGNQTVLLRGINGCTHVMKRLVHLLVKIRVRPYYIYACDLSLGIGHFRTPISKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKKRRSDKN

SEQ ID NO: 3065 - DNA, 1251 bp, Artificial Sequence
  Description of Artificial Sequence: Synthetic Construct
atggcagaaagtcgtagaaagtattatttccctgatgtcaccgatgagcaatggtgcgactggcattggcaggtcatcaatcgaattaagacgctcgaccagctggagaagtacgttacactcaccgctgaagaagaagagggagtaaaagaatcgcccaaagtactccgaatggctatcacaccttattatttgaatttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtatgacgcctcgattggtggatatgctcaaaaaatatcatccggtgtggctgaacactcacttcaaccacccgaatgaagttaccgaagaagcagtggaggcttgtggaggaatggccaatgccggtattccgttgggtaaccaaacggttttattgcgtggaatcaatggttgtacacatgtgatgaagagattggtacatttgctggtaaagattcgtgtgcgtccttactatatatatgcttgcgatctttcgcttggaatagggcatttccgcacgccgatatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggttttagagcctcccgacttagctcgcaaaaaacgcaggagcgataagaactaa

SEQ ID NO: 3066 - protein, 416 aa, Artificial Sequence
  Description of Artificial Sequence: Synthetic Construct
MAESRRKYYFPDVTDEQWCDWHWQVINRIKTLDQLEKYVTLTAEEEEGVKESPKVLRMAITPYYLNLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRMTPRLVDMLKKYHPVWLNTHFNHPNEVTEEAVEACGGMANAGIPLGNQTVLLRGINGCTHVMKRLVHLLVKIRVRPYYIYACDLSLGIGHFRTPISKGIEIIENLRGHTSGYAVPTFVVHAPGGGGKIPVAPNYVVSQSPRHVVLRNYEGVITTYTEPEDYHEECDCEDCRVDKHREGVAALSGGQQLVLEPPDLARKKRRSDKN

SEQ ID NO: 3067 - DNA, 1251 bp, Artificial Sequence
  Description of Artificial Sequence: Synthetic Construct
atggcagaaagtcgtagaaagtattatttccctgatgtcaccaatgagcaatggtgcgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttacccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcgattggtggatatgctcaaaaaatatcatccggtgtggctgaacactcacttcaaccacccgaatgaagttaccgaagaagcagtggaggcttgtgaaggaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccgatatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggttttagagcctcccgacttagctcgcaaaaaacgcaggagcgataagaactaa

SEQ ID NO: 3068 - protein, 416 aa, Artificial Sequence
  Description of Artificial Sequence: Synthetic Construct
MAESRRKYYFPDVTNEQWCDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPRLVDMLKKYHPVWLNTHFNHPNEVTEEAVEACEGMANAGIPLGNQTVLLRGINDCTHVMKRLVHLLVKIRVRPYYIYACDLSLGIGHFRTPISKGIEIIENLRGHTSGYAVPTFVVHAPGGGGKIPVAPNYVVSQSPRHVVLRNYEGVITTYTEPEDYHEECDCEDCRVDKHREGVAALSGGQQLVLEPPDLARKKRRSDKN

SEQ ID NO: 3069 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcggagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtggaggaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgaactttccggaggtcagcagttggttttagtgcctcccgacttagctcgcaaaaaacgcaggagcgataagaactaa

SEQ ID NO: 3070 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLRGVPHVEIVRIGSRAPVVLPQRITPQLVDMLKKYHPVWLNTHFNHPNEVTEEAVEACGGMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAELSGGQQLVLVPPDLARKKRRSDKN

SEQ ID NO: 3071 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaggacgctcgaccagctggagaagtacgttacactcaccgctgaagaagaagagggagtaaaagaatcgcccaaagtactccgaatggctatcacaccttattatttgagtttgataaaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcggagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccgatatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgaactttccggaggtcagcagttggttttagagcctcccgacttagctcgcaaaaaacgcaggagcgataagaactaa

SEQ ID NO: 3072 - protein, 416 aa, Artificial Sequence
  Description of Artificial Sequence: Synthetic Construct
MAESRRKYYFPDVTDEQWYDWHWQVINRIRTLDQLEKYVTLTAEEEEGVKESPKVLRMAITPYYLSLINPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLRGVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPISKGIEIIENLRGHTSGYAVPTFVVHAPGGGGKIPVAPNYVVSQSPRHVVLRNYEGVITTYTEPEDYHEECDCEDCRVDKHREGVAELSGGQQLVLEPPDLARKKRRSDKN

SEQ ID NO: 3073 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaggacgctcgaccagctggagaagtacgttacactcaccgctgaggaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtatgacgcctcgattggtggatatgctcaaaaaatatcatccggtgtggctgaacactcacttcaaccacccgaatgaagttaccgaagaagcagtgggggcttgtgaaagaatggccaatgccggtattccgttgggtaaccaaacggttttattgcgtggaatcaatggttgtacacatgtgatgaagagattggtacatttgctggtaaagattcgtgtgcgtccttactatatatatgcttgcgatctttcgcttggaatagggcatttccgcacgccgatatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggttttagagcctcccgacttagctcgcaaaaaacgcaggagcgataagaactaa

SEQ ID NO: 3074 - protein, 416 aa, Artificial Sequence
  Description of Artificial Sequence: Synthetic Construct
MAESRRKYYFPDVTDEQWYDWHWQVINRIRTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRMTPRLVDMLKKYHPVWLNTHFNHPNEVTEEAVGACERMANAGIPLGNQTVLLRGINGCTHVMKRLVHLLVKIRVRPYYIYACDLSLGIGHFRTPISKGIEIIENLRGHTSGYAVPTFVVHAPGGGGKIPVAPNYVVSQSPRHVVLRNYEGVITTYTEPEDYHEECDCEDCRVDKHREGVAALSGGQQLVLEPPDLARKKRRSDKN

SEQ ID NO: 3075 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaggacgctcgaccagctggagaagtacgttacactcaccgctgaagaagaagagggagtaaaagaatcgcccaaagtactccgaatggctatcacaccctattatttgagtttgatagaccccgaggatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttccgagcgcatcgatcgatgcattgagtatatagccaatacaccgacagtccgcgatgtcttgctatcgggaggcgatgccctccttgtcagcgacgaacgcttggaatacatattgaagcgtctgcgcggagtacctcatgtggagattgttcgtataggaagccgtgcgccggtagtcctccctcagcgtatgacgcctcaattggtggatatgctcaaaaaatatcatccggtgtggctgaacactcacttcaaccacccgaatgaagttaccgaagaagcagtgggggcttgtggaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacggcatgtggttcttcgcaattatgaaggtgttatcacaacctatacggagccggaggactatcatgaggagtgcgattgtgaggactgccgagtcgacaagcatcgtgagggcgtggctacactttcctgaggtcagcagttggctttagagcctcccgacttagctcgcaaaaaacgcaggagcgataagaactaa

SEQ ID NO: 3076 - protein, 394 aa, Artificial Sequence
  Description of Artificial Sequence: Synthetic Construct
MAESRRKYYFPDVTDEQWYDWHWQVINRIRTLDQLEKYVTLTAEEEEGVKESPKVLRMAITPYYLSLIDPEDPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLRGVPHVEIVRIGSRAPVVLPQRMTPQLVDMLKKYHPVWLNTHFNHPNEVTEEAVGACGRMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVATLS

SEQ ID NO: 3077 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggaggagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcggagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtggaggaatggccaatgccggtattccgttgggtaaccaaacggttttattgcgtggaatcaatggttgtacacatgtgatgaagagattggtacatttgctggtaaagattcgtgtgcgtccttactatatatatgcttgcgatctttcgcttggaatagggcatttccgcacgccgatatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaagtgttatcacaacctatacggagccggtggactatcatgaggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3078 - protein, 416 aa, Artificial Sequence
  Description of Artificial Sequence: Synthetic Construct
MAESRRKYYFPDVTDEQWYDWHWQVINRIKTLDQLEEYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLRGVPHVEIVRIGSRAPVVLPQRITPQLVDMLKKYHPVWLNTHFNHPNEVTEEAVEACGGMANAGIPLGNQTVLLRGINGCTHVMKRLVHLLVKIRVRPYYIYACDLSLGIGHFRTPISKGIEIIENLRGHTSGYAVPTFVVHAPGGGGKIPVAPNYVVSQSPRHVVLRNYESVITTYTEPVDYHEECDCEDCRVDKHREGVAALSGGQQLALEPPDLARKKRRSDKN

SEQ ID NO: 3079 - DNA, 1251 bp, Artificial Sequence
  Description of Artificial Sequence: Synthetic Construct
atggcagaaagtcgtagaaagtattatttccctgatgtcaccgatgagcaatggtgcgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgataaaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcggagtacctcatgtggagattgttcgtataggaagccgtgcgccggtagtcctccctcagcgtatgacgcctcgattggtggatatgctcaaaaaatatcatccggtgtggctgaacactcacttcaaccacccgaatgaagttaccgaagaagcagtggaggcttgtggaagaatggccaatgccggtattccgttgggtaaccaaacggttttattgcgtggaatcaatggttgtacacatgtgatgaagagattggtacatttgctggtaaagattcgtgtgcgtccttactatatatatgcttgcgatctttcgcttggaatagggcatttccgcacgccgatatctaaaggaatcgaaattatcgaaaatttgcgcggacacacctcgggctatgcagttcctacctttgtggtacatgctccggggggtggtggtaagatacctgtagcgccgaactatgttgtatctcagtccccacgtcatgtggttcttcgcaattatgaaggtgttatcacaacctatacggagccggaggactatcatgaggagtgcgattgtgaggactgccgagtcgacaagcatcgtgagggcgtggctgaactttccggaggtcagcagttggctttagagcctcccgacttagctcgcaaaaaacgcaggagcgataagaactaa

SEQ ID NO: 3080 - protein, 416 aa, Artificial Sequence
  Description of Artificial Sequence: Synthetic Construct
MAESRRKYYFPDVTDEQWCDWHWQVINRIKTLDQLEKYVTLTAEEEEGVKESPKVLRMAITPYYLSLINPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLRGVPHVEIVRIGSRAPVVLPQRMTPRLVDMLKKYHPVWLNTHFNHPNEVTEEAVEACGRMANAGIPLGNQTVLLRGINGCTHVMKRLVHLLVKIRVRPYYIYACDLSLGIGHFRTPISKGIEIIENLRGHTSGYAVPTFVVHAPGGGGKIPVAPNYVVSQSPRHVVLRNYEGVITTYTEPEDYHEECDCEDCRVDKHREGVAELSGGQQLALEPPDLARKKRRSDKN

SEQ ID NO: 3081 - DNA, 1251 bp, Artificial Sequence
  Description of Artificial Sequence: Synthetic Construct
atggcagaaagtcgtagaaagtattatttccctgatgtcaccgatgagcaatggtgcgactggcattggcaggtcatcaatcgaattaggacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcggcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcggagtacctcatgtggagattgttcgtataggaagccgtgcgccggtagtcctccctcagcgtatgacgcctcgattggtggatatgctcaaaaaatatcatccggtgtgactgaacactcacttcaaccacccgaatgaagttaccgaagaagcagtgggggcttgtgaaagaatggccaatgccggtattccgttgggtaaccaaacggttttattgcgtggaatcaatggttgtacacatgtgatgaagagattggtacatttgctggtaaagattcgtgtgcgtccttactatatatatgcttgcgatctttcgcttggaatagggcatttccgcacgccgatatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctacactttccggaggtcagcagttggctttagagcctcccgacttagctcgcaaaaaacgcaggagcgataagaactaa

SEQ ID NO: 3082 - protein, 226 aa, Artificial Sequence
  Description of Artificial Sequence: Synthetic Construct
MAESRRKYYFPDVTDEQWCDWHWQVINRIRTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLRGVPHVEIVRIGSRAPVVLPQRMTPRLVDMLKKYHPV

SEQ ID NO: 3083 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtatgacgcctcgattggtggatatgctcaaaaaatatcatccggtgtggctgaacactcacttcaaccacccgaatgaagttaccgaagaagcagtggaggcttgtgaaggaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccgatatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctacactttccggaggtcagcagttggctttagagcctcccgacttagctcgcaaaaaacgcaggagcgataagaactaa

SEQ ID NO: 3084 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRMTPRLVDMLKKYHPVWLNTHFNHPNEVTEEAVEACEGMANAGIPLGNQTVLLRGINDCTHVMKRLVHLLVKIRVRPYYIYACDLSLGIGHFRTPISKGIEIIENLRGHTSGYAVPTFVVHAPGGGGKIPVAPNYVVSQSPRHVVLRNYEGVITTYTEPEDYHEECDCEDCRVDKHREGVATLSGGQQLALEPPDLARKKRRSDKN

SEQ ID NO: 3085 - DNA, 1251 bp, Artificial Sequence
  Description of Artificial Sequence: Synthetic Construct
atggcagaaagtcgtagaaagtattatttccctgatgtcaccgatgagcaatggtgcgactggcattggcaggtcatcaatcgaattaagacgctcgaccagctggagaagtacgttacactcaccgctgaggaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtatgacgcctcgattggtggatatgctcaaaaaatatcatccggtgtggctgaacactcacttcaaccacccgaatgaagttaccgaagaagcagtgggggcttgtgaaggaatggccaatgccggtattccgttgggtaaccaaacggttttattgcgtggaatcaatggttgtacacatgtgatgaagagattggtacatttgctggtaaagattcgtgtgcgtccttactatatatatgcttgcgatctttcgcttggaatagggcatttccgcacgccgatatctaaaggaatcgaaattatcgaaaatttgcgcggacacacctcgggctatgcagttcctacctttgtggtacatgctccggtgggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctacactttccggaggtcagcagttggttttagagcctcccgacttagctcgcaaaaaacgcaggagcgataagaactaa

SEQ ID NO: 3086 - protein, 416 aa, Artificial Sequence
  Description of Artificial Sequence: Synthetic Construct
MAESRRKYYFPDVTDEQWCDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRMTPRLVDMLKKYHPVWLNTHFNHPNEVTEEAVGACEGMANAGIPLGNQTVLLRGINGCTHVMKRLVHLLVKIRVRPYYIYACDLSLGIGHFRTPISKGIEIIENLRGHTSGYAVPTFVVHAPVGGGKIPVAPNYVVSQSPRHVVLRNYEGVITTYTEPEDYHEECDCEDCRVDKHREGVATLSGGQQLVLEPPDLARKKRRSDKN

SEQ ID NO: 3087 - DNA, 1251 bp, Artificial Sequence
  Description of Artificial Sequence: Synthetic Construct
atggcagaaagtcgtagaaagtattatttccctgatgtcaccaatgagcaatggtacgactggcattggcaggtcatcaatcgaattaggacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcggagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtggaagaatggccaatgccggtattccgttgggtaaccaaacggttttattgcgtggaatcaatggttgtacacatgtgatgaagagattggtacatttgctggtaaagattcgtgtgcgtccttactatatatatgcttgcgatctttcgcttggaatagggcatttccgcacgccgatatctaaaggaatcgaaattatcgaaaatttgcgcggacacacctcgggctatgcagttcctacctttgtggtacatgctccggggggtggtggtaaggtacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctacactttccggaggtcagcagttggctttagagcctcccgacttagctcgcaaaaaacgcaggagcgataagaactaa

SEQ ID NO: 3088 - protein, 416 aa, Artificial Sequence
  Description of Artificial Sequence: Synthetic Construct
MAESRRKYYFPDVTNEQWYDWHWQVINRIRTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLRGVPHVEIVRIGSRAPVVLPQRITPQLVDMLKKYHPVWLNTHFNHPNEVTEEAVEACGRMANAGIPLGNQTVLLRGINGCTHVMKRLVHLLVKIRVRPYYIYACDLSLGIGHFRTPISKGIEIIENLRGHTSGYAVPTFVVHAPGGGGKVPVAPNYVVSQSPRHVVLRNYEGVITTYTEPEDYHEECDCEDCRVDKHREGVATLSGGQQLALEPPDLARKKRRSDKN

SEQ ID NO: 3089 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgataaaccccgagaatcctaattgtccgatacgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtatgacgcctcgattggtggatatgctcaaaaaatatcatccggtgtggctgaacactcacttcaaccacccgaatgaagttaccgaagaagcagtggaggcttgtgaaggaatggccaatgccggtattccgttgggtaaccaaacggttttattgcgtggaatcaatggttgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggttttagagcctcccgacttagctcgcaaaaaacgcaggagcgataagaactaa

SEQ ID NO: 3090 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLINPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRMTPRLVDMLKKYHPVWLNTHFNHPNEVTEEAVEACEGMANAGIPLGNQTVLLRGINGCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLVLEPPDLARKKRRSDKN

SEQ ID NO: 3091 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctggggaagaagggggagtaaaagaatcgcccaaagtactccgaatggctatcacaccttattatttgagtttgataaaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcggagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacaccgatatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggttttagagcctcccgacttagctcgcaaaaaacgcaggagcgataagaactaa

SEQ ID NO: 3092 - protein, 416 aa, Artificial Sequence
  Description of Artificial Sequence: Synthetic Construct
MAESRRKYYFPDVTDEQWYDWHWQVINRIKTLDQLEKYVTLTAGEEGGVKESPKVLRMAITPYYLSLINPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLRGVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPISKGIEIIENLRGHTSGYAVPTFVVHAPGGGGKIPVAPNYVVSQSPRHVVLRNYEGVITTYTEPEDYHEECDCEDCRVDKHREGVAALSGGQQLVLEPPDLARKKRRSDKN

SEQ ID NO: 3093 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaggacgctcgaccagctggagaagtacgttacactcaccgctggggaagaagggggagtaaaagaatcgcccaaagtactccgaatggctatcacaccttattatttgagtttgataaaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtgggggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccgatatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgaactttccggaggtcagcagttggttttagagcctcccgacttagctcgcaaaaaacgcaggagcgataagaactaa

SEQ ID NO: 3094 - protein, 416 aa, Artificial Sequence
  Description of Artificial Sequence: Synthetic Construct
MAESRRKYYFPDVTDEQWYDWHWQVINRIRTLDQLEKYVTLTAGEEGGVKESPKVLRMAITPYYLSLINPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVGACERMANAGIPLGNQTVLLRGINDCTHVMKRLVHLLVKIRVRPYYIYACDLSLGIGHFRTPISKGIEIIENLRGHTSGYAVPTFVVHAPGGGGKIPVAPNYVVSQSPRHVVLRNYEGVITTYTEPEDYHEECDCEDCRVDKHREGVAELSGGQQLVLEPPDLARKKRRSDKN

SEQ ID NO: 3095 - DNA, 1251 bp, Artificial Sequence
  Description of Artificial Sequence: Synthetic Construct
atggcagaaagtcgtagaaagtattatttccctgatgtcaccaatgagcaatggtgcgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgataaaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcgattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccgatatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaggcatcgtgagggcgtggctgcactttccggaggtcagcagttggctttagagcctcccgacttagctcgcaaaaaacgcaggagcgataagaactaa

SEQ ID NO: 3096 - protein, 416 aa, Artificial Sequence
  Description of Artificial Sequence: Synthetic Construct
MAESRRKYYFPDVTNEQWCDWHWQVINRIKTLDQLEKYVTLTAEEEEGVKESPKVLRMAITPYYLSLINPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPRLVDMLKKYHPVWLNTHFNHPNEVTEEAVEACERMANAGIPLGNQTVLLRGINDCTHVMKRLVHLLVKIRVRPYYIYACDLSLGIGHFRTPISKGIEIIENLRGHTSGYAVPTFVVHAPGGGGKIPVAPNYVVSQSPRHVVLRNYEGVITTYTEPEDYHEECDCEDCRVDRHREGVAALSGGQQLALEPPDLARKKRRSDKN

SEQ ID NO: 3097 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacgggaactggtacgtgctcctgaagatatggtagacccacttagtgaagatgaagattcgcccgtacccggactgactcatcgttatccggatcgtgtattgttccttatcacggacaaatgttcgatgtactgtcgtcgttgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagattcgtgtgcgtccttactatatatatgcttgcgatctttcgcttggaatagggcatttccgcacgccggtatctaaaggaatcgaaattaacgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3098 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRRCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEINENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 3099 - DNA, 1251 bp, Artificial Sequence
  Description of Artificial Sequence: Synthetic Construct
atggcagaaagtcgtagaaagcattatttccctgatgtcaccgatgagcaagggtacgactggcattggcaggtcatcaatcgaattaagacgctcggccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgtcgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcatctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattaccgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatggggagtgcgattgtgaggactgccgagtcgacaagcatcgtgagggcgtggctgcactttccggaggtcagcagttggctttagagcctcccgacttagctcgcaaagaacgcaggagcgataggaactaa

SEQ ID NO: 3100 - protein, 416 aa, Artificial Sequence
  Description of Artificial Sequence: Synthetic Construct
MAESRRKHYFPDVTDEQGYDWHWQVINRIKTLGQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKHLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEITENLRGHTSGYAVPTFVVHAPGGGGKIPVAPNYVVSQSPRHVVLRNYEGVITTYTEPEDYHGECDCEDCRVDKHREGVAALSGGQQLALEPPDLARKERRSDRN

SEQ ID NO: 3101 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgccgggaactggtacgtgctcctgaagatatggtagacccacttagtgaagatgaagattcgcccgtacccggactgactcatcgttatccggatcgtgtattgttccttatcacggacaaatgttcgatgtactgtcgtcgttgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcatctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattaacgaaaatttgcgcggacacacctcgggctatgcagttcctacctttgtggtacatgctccggggggtggtggtaagatacctgtggcgccgaactatgttgtatctcagtccccacgacatgtgattcttcgcaattatgaaggtgttatcacaacctatacggagccggaggactatcatggggagtgcgattgtgaggactgccgagtcgacaagcatcgtgagggcgtggctgcactttccggaggtcagcagttggctttagagcctcccgacttagctcgcaaagaacgcaggagcgataggaactaa

SEQ ID NO: 3102 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRRCTRRRFAGQRDASSPSERIDRCIEYIANTPTVRDVLLSGGDALLVSDERLEYILKHLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEINENLRGHTSGYAVPTFVVHAPGGGGKIPVAPNYVVSQSPRHVILRNYEGVITTYTEPEDYHGECDCEDCRVDKHREGVAALSGGQQLALEPPDLARKERRSDRN

SEQ ID NO: 3103 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcggccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgccgggaactggtacgtgctcctgaagatatggtagacccacttagtgaagatgaagattcgcccgtacccggactgactcatcgttatccggatcgtgtattgttccttatcacggacaaatgttcgatgtactgtcgtcgttgtactcgccgtcgcttcgcaggacagagagatgcttcttctccttctgagcgcatcgatcgatgcattgagtatatagccaatacaccgacagtccgcgatgttttgctatcgggaggcggtgccctccttgtcagcgacgaacgcttggaatacatattgaagcatctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattaccgaaaatttgcgcggacacacctcgggctatgcagttcctaccttcgtggtacatgctccggggggtggtggtaagatacctgtagcgccgaactatgttgtatctcagtccccacgacatgtggttcttcgcaattatgaaggtgttatcacaacctatacggagccggaggactatcatggggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3104 - protein, 416 aa, Artificial Sequence
  Description of Artificial Sequence: Synthetic Construct
MAESRRKHYFPDVTDEQWYDWHWQVINRIKTLGQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRRCTRRRFAGQRDASSPSERIDRCIEYIANTPTVRDVLLSGGGALLVSDERLEYILKHLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEITENLRGHTSGYAVPTFVVHAPGGGGKIPVAPNYVVSQSPRHVVLRNYEGVITTYTEPEDYHGECDCEDCRVDKHREGVAALSGGQQLALEPPDLARKKRRSDKN

SEQ ID NO: 3105 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcggccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatggggagtgcgattgtgaggactgccgagtcgacaagcatcgtgagggcgtggctgcactttccggaggtcagcagttggctttagagcctcccgacttagctcgcaaagaacgcaggagcgataggaactaa

SEQ ID NO: 3106 - protein, 416 aa, Artificial Sequence
  Description of Artificial Sequence: Synthetic Construct
MAESRRKHYFPDVTDEQWYDWHWQVINRIKTLGQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVAPNYVVSQSPRHVVLRNYEGVITTYTEPEDYHGECDCEDCRVDKHREGVAALSGGQQLALEPPDLARKERRSDRN

SEQ ID NO: 3107 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgccgggaactggtacgtgctcctgaagatatggtagacccacttagtgaagatgaagattcgcccgtacccggactggctcatcgttatccggatcgtgtattgttccttatcacggacaaatgttcgatgtactgtcgtcgttgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcatctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattaccgaaaatttgcgcggacacacctcgggctatgcagttcctacctttgtggtacatgctccggggggtggtggtaagatacctgtggcgccgaactatgttgtatctcagtccccacgacgtgtgattcttcgcaattatgaaggtgttatcacaacctatacggagccggaggactatcatggggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3108 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTRRELVRAPEDMVDPLSEDEDSPVPGLAHRYPDRVLFLITDKCSMYCRRCTRRRFAGQRDASSPSERIDRCIEYIANTPTVRDVLLSGGDALLVSDERLEYILKHLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEITENLRGHTSGYAVPTFVVHAPGGGGKIPVAPNYVVSQSPRRVILRNYEGVITTYTEPEDYHGECDCEDCRVDKHREGVAALSGGQQLALEPPDLARKERRSDKN

SEQ ID NO: 3109 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcggccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgtcgggaactggtacgtgctcctgaagatatggtagacccacttagtgaagatgaagattcgcccgtacccggactgactcatcgttatccggatcgtgtattgttccttatcacggacaaatgttcgatgtactgtcgtcgttgtactcgccgtcgcttcgcaggacagagagatgcttcttctccttctgagcgcatcgaccgatgcattgagtatatagccaatacaccgacagtccgcgatgttttgctatcgggaggcgatgccctccttgtcagcgacgaacgcttggaatacatattgaagcatctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagattcgtgtgcgtccttactatatatatgcttgcgatctttcgcttggaatagggcatttccgcacgccggtatctaaaggaatcgaaattatcgaaaatttgcgcggacacaccccgggctatgcagttcctacctttgtggtacatgctccggggggtggtggtaagatacctgtggcgccgaactatgttgtatctcagtccccacgacgtgtgattcttcgcaattatgaaggtgttatcacaacctatacggagccggaggactatcatgaggagtgcgattgtgaggactgccgagtcggcaagcatcgtgagggcgtggctgcactttccggaggtcagcagttggctttagagcctcccgacttagctcgcaaagaacgcaggagcgataagaactaa

SEQ ID NO: 3110 - protein, 416 aa, Artificial Sequence
  Description of Artificial Sequence: Synthetic Construct
MAESRRKHYFPDVTDEQWYDWHWQVINRIKTLGQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRRCTRRRFAGQRDASSPSERIDRCIEYIANTPTVRDVLLSGGDALLVSDERLEYILKHLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTPGYAVPTFVVHAPGGGGKIPVAPNYVVSQSPRRVILRNYEGVITTYTEPEDYHEECDCEDCRVGKHREGVAALSGGQQLALEPPDLARKERRSDKN

SEQ ID NO: 3111 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcggccagctggagaagtacgttacactcaccgctgaagaagaagagggagtaaaagaatcgcccaaggtactccgaatggctatcacaccttattatttgagtttgatagaccccgagaatcctaattgtccgattcgtaaacaagccattcctactcgtcgggaactggtacgtgctcctgaagatatggtagacccacttagtgaagatgaagattcgcccgtacccggactgactcatcgttatccggatcgtgtattgttccttatcacggacaaatgttcgatgtactgtcgtcgttgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcatctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagattcgtgtgcgtccttactatatatatgcttgcgatctttcgcttggaatagggcatttccgcacgccggtatctaaaggaatcgaaattaccgaaaatttgcgcggacacacctcgggctatgcagttcctacctttgtggtacatgctccggggggtggtggtaagatacctgtggcgccgaactatgttgtatctcagtccccacgacatgtggttcttcgcaattatgaaggtgttaccacaacctatacggagccggaggactatcatgaggagtgcgattgtgaggactgccgagccgacaagcatcgtgagggcgtggctgcactttccggaggtcagcagttggctttagagcctcccgacttagctcgcaaagaacgcaggagcgataggaactaa

SEQ ID NO: 3112 - protein, 416 aa, Artificial Sequence
  Description of Artificial Sequence: Synthetic Construct
MAESRRKHYFPDVTDEQWYDWHWQVINRIKTLGQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRRCTRRRFAGQRDASSPSERIDRCIEYIANTPTVRDVLLSGGDALLVSDERLEYILKHLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEITENLRGHTSGYAVPTFVVHAPGGGGKIPVAPNYVVSQSPRHVVLRNYEGVTTTYTEPEDYHEECDCEDCRADKHREGVAALSGGQQLALEPPDLARKERRSDRN

SEQ ID NO: 3113 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcatctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagattcgtgtgcgtccttactatatatatgcttgcgatctttcgcttggaatagggcatttccgcacgccggtatctaaaggaatcgaaattaccgaaaatttgcgcggacacacctcgggctatgcagttcctacctttgtggtacatgctccggggggtggtggtaagatacctgtggcgccgaactatgttgtatctcagtccccacgacatgtggttcttcgcaattatgaaggtgttatcacaacctatacggagccggaggactatcatgaggagtgcgattgtgaggactgccgagccgacaagcatcgtgagggcgtggctgcactttccggaggtcagcagttggctttagagcctcccgacttagctcgcaaagaacgcaggagcgataggaactaa

SEQ ID NO: 3114 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKHLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEITENLRGHTSGYAVPTFVVHAPGGGGKIPVAPNYVVSQSPRHVVLRNYEGVITTYTEPEDYHEECDCEDCRADKHREGVAALSGGQQLALEPPDLARKERRSDRN

SEQ ID NO: 3115 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacgggaactggtacgtgctcctgaagatatggtagacccacttagtgaagatgaagattcgcccgtacccggactgactcatcgttatccggatcgtgtattgttccttatcacggacaaatgttcgatgtactgtcgtcgttgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcatctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccactgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattaacgaaaatttgcgcggacacacctcgggctatgcagttcctacctttgtggtacatgctccggggggtggtggtaagatacctgtggcgccgaactatgttgtatctcagtccccacgacatgtggttcttcgcaattatgaaggtgttatcacaacctatacggagccggaggactatcatgaggagtgcgattgtgaggactgccgagccggcaagcatcgtgagggcgtggctgcactttccggaggtcagcagttggctttagagcctcccgacttagctcgcaaaaaacgcaggagcgataagaactaa

SEQ ID NO: 3116 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRRCTRRRFAGQRDASSPSERIDRCIEYIANTPTVRDVLLSGGDALLVSDERLEYILKHLREVPHVEIVRIGSRAPVVLPQRITPQLVDMLKKYHPVWLNTHFNHPNEVTEEAVEACERMATAGIPLGNQTVLLRGINDCTHVMKRLVHLLVKIRVRPYYIYACDLSLGIGHFRTPVSKGIEINENLRGHTSGYAVPTFVVHAPGGGGKIPVAPNYVVSQSPRHVVLRNYEGVITTYTEPEDYHEECDCEDCRAGKHREGVAALSGGQQLALEPPDLARKKRRSDKN

SEQ ID NO: 3117 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcggccagctggagaagtacgttacactcaccgctgaagaagaagagggagtaaaagaatcgcccaaagtacaccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcgttgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattaacgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3118 - protein, 416 aa, Artificial Sequence
  Description of Artificial Sequence: Synthetic Construct
MAESRRKHYFPDVTDEQWYDWHWQVINRIKTLGQLEKYVTLTAEEEEGVKESPKVHRMAITPYYLSLIDPENPNCPIRKQAIPTKRELVRAPEDMVDPLSEDEDSPVPGLTHRYPDRVLFLITDKCSMYCRRCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEINENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 3119 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgtcgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagattcgtgtgcgtccttactatatatatgcttgcgatctttcgcttggaatagggcatttccgcacgccggtatctaaaggaatcgaaattaccgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataggaactaa

SEQ ID NO: 3120 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEITENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDRN

SEQ ID NO: 3121 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcggccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatggggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3122 - protein, 416 aa, Artificial Sequence
  Description of Artificial Sequence: Synthetic Construct
MAESRRKHYFPDVTDEQWYDWHWQVINRIKTLGQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHGECDCEDCRVDKHREGVAALSGGQQLALEPPDLARKERRSDKN

SEQ ID NO: 3123 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcggccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgtcgggaactggtacgtgctcctgaagatatggtagacccacttagtgaagatgaagattcgcccgtacccggactgactcatcgttatccggatcgtgtattgttccttatcacggacaaatgttcgatgtactgtcgtcgttgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcatctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattaccgaaaatttgcgcggacacacctcgggctatgcagttcctacctttgtggtacatgctccggggggtggtggtaagatacctgtagcgccgaactatgttgtatctcagtccccacgacatgtgattcttcgcaattatgaaggtgttatcacaacctatacggagccggaggactatcatggggagtgcgattgtgaggactgccgagtcgacaagcatcgtgagggcgtggctgcactttccggaggtcagcagttggctttagagcctcccgacttagctcgcaaagaacgcaggagcgataggaactaa

SEQ ID NO: 3124 - protein, 416 aa, Artificial Sequence
  Description of Artificial Sequence: Synthetic Construct
MAESRRKHYFPDVTDEQWYDWHWQVINRIKTLGQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRRCTRRRFAGQRDASSPSERIDRCIEYIANTPTVRDVLLSGGDALLVSDERLEYILKHLREVPHVEIVRIGSRAPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEITENLRGHTSGYAVPTFVVHAPGGGGKIPVAPNYVVSQSPRHVILRNYEGVITTYTEPEDYHGECDCEDCRVDKHREGVAALSGGQQLALEPPDLARKERRSDRN

SEQ ID NO: 3125 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcggccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgtcgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattaccgaaaatttgcgcggacacacctcgggctatgcagttcctacctttgtggtacatgctccggggggtggtggtaagatacctgtggcgccgaactatgttgtatctcagtccccacgacatgtggttcttcgcaattatgaaggtgttatcacaacctatacggagccggaggactatcatggggagtgcgattgtgaggactgccgagtcggcaagcatcgtgagggcgtggctgcactttccggaggtcagcagttggctttagagcctcccgacttagctcgcaaagaacgcaggagcgataggaactaa

SEQ ID NO: 3126 - protein, 416 aa, Artificial Sequence
  Description of Artificial Sequence: Synthetic Construct
MAESRRKHYFPDVTDEQWYDWHWQVINRIKTLGQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEITENLRGHTSGYAVPTFVVHAPGGGGKIPVAPNYVVSQSPRHVVLRNYEGVITTYTEPEDYHGECDCEDCRVGKHREGVAALSGGQQLALEPPDLARKERRSDRN

SEQ ID NO: 3127 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgtcgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacgccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacgtgtgattcttcgcaattatgaaggtgttaccacaacctatacggagccggaggactatcatggggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3128 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRRVILRNYEGVTTTYTEPEDYHGECDCEDCRVDKHREGVAALSGGQQLALEPPDLARKERRSDKN

SEQ ID NO: 3129 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcggccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagattcgtgtgcgtccttactatatatatgcttgcgatctttcgcttggaatagggcatttccgcacgccggtatctaaaggaatcgaaattaacgaaaatttgcgcggacacacctcgggctatgcagttcctacctttgtggtacatgctccggggggtggtggtaagatacctgtggcgccgaactatgttgtatctcagtccccacgacgtgtggttcttcgcaattatgaaggtgttatcacaacctatacggagccggaggactatcatgaggagtgcgattgtgaggactgccgagccgacaagcatcgtgagggcgtggctgcactttccggaggtcagcagttggctttagagcctcccgacttagctcgcaaagaacgcaggagcgataagaactaa

SEQ ID NO: 3130 - protein, 416 aa, Artificial Sequence
  Description of Artificial Sequence: Synthetic Construct
MAESRRKHYFPDVTDEQWYDWHWQVINRIKTLGQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEINENLRGHTSGYAVPTFVVHAPGGGGKIPVAPNYVVSQSPRRVVLRNYEGVITTYTEPEDYHEECDCEDCRADKHREGVAALSGGQQLALEPPDLARKERRSDKN

SEQ ID NO: 3131 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgtcgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcatctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagattcgtgtgcgtccttactatatatatgcttgcgatctttcgcttggaatagggcatttccgcacgccggtatctaaaggaatcgaaattaccgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatggggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3132 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKHLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEITENLRGHTSGYAVPTFVVHAPGGGGKIPVAPNYVVSQSPRHVVLRNYEGVITTYTEPEDYHGECDCEDCRVDKHREGVAALSGGQQLALEPPDLARKERRSDKN

SEQ ID NO: 3133 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgccgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcatctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaaggtgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtggcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataggaactaa

SEQ ID NO: 3134 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKHLREVPHVEIVRIGSRAPVVLPQRITPQLVDMLKKYHPVWLNTHFNHPNEVTEEAVEACERMANAGIPLGNQTVLLRGINDCTHVMKRLVHLLVKVRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDRN

SEQ ID NO: 3135 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcggccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattaccgaaaatttgcgcggacacacctcgggctatgcagttcctacctttgtggtacatgctccggggggtggtggtaagatacctgtagcgccgaactatgttgtatctcagtccccacgacgtgtggttcttcgcaattatgaaggtgttatcacaacctatacggagccggaggactatcatggggagtgcgattgtgaggactgccgagccgacaagcatcgtgagggcgtggctgcactttccggaggtcagcagttggctttagagcctcccgacttagctcgcaaagaacgcaggagcgataggaactaa

SEQ ID NO: 3136 - protein, 416 aa, Artificial Sequence
  Description of Artificial Sequence: Synthetic Construct
MAESRRKHYFPDVTDEQWYDWHWQVINRIKTLGQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEITENLRGHTSGYAVPTFVVHAPGGGGKIPVAPNYVVSQSPRRVVLRNYEGVITTYTEPEDYHGECDCEDCRADKHREGVAALSGGQQLALEPPDLARKERRSDRN

SEQ ID NO: 3137 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgtcgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattaccgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatggggagtgcgattgtgaggactgccgagccgacaagcatcgtgagggcgtggctgcactttccggaggtcagcagttggctttagagcctcccgacttagctcgcaaagaacgcaggagcgataggaactaa

SEQ ID NO: 3138 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEITENLRGHTSGYAVPTFVVHAPGGGGKIPVAPNYVVSQSPRHVVLRNYEGVITTYTEPEDYHGECDCEDCRADKHREGVAALSGGQQLALEPPDLARKERRSDRN

SEQ ID NO: 3139 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcggccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgccgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagattcgtgtgcgtccttactatatatatgcttgcgatctttcgcttggaatagggcatttccgcacgccggtatctaaaggaatcgaaattaccgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3140 - protein, 416 aa, Artificial Sequence
  Description of Artificial Sequence: Synthetic Construct
MAESRRKHYFPDVTDEQWYDWHWQVINRIKTLGQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEITENLRGHTSGYAVPTFVVHAPGGGGKIPVAPNYVVSQSPRHVVLRNYEGVITTYTEPEDYHEECDCEDCRVDKHREGVAALSGGQQLALEPPDLARKKRRSDKN

SEQ ID NO: 3141 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcggccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgccgggaactggtacgtgctcctgaagatatggtagacccacttagtgaagatgaagattcgcccgtacccggactgactcatcgttatccggatcgtgtattgttccttatcacggacaaatgttcgatgtactgtcgtcgttgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcatctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaaggtgcgtgtgcgtccttactatatatatgcttgcgatctttcgcttggaatagggcatttccgcacgccggtatctaaaggaatcgaaattaacgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatggggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3142 - protein, 416 aa, Artificial Sequence
  Description of Artificial Sequence: Synthetic Construct
MAESRRKHYFPDVTDEQWYDWHWQVINRIKTLGQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRRCTRRRFAGQRDASSPSERIDRCIEYIANTPTVRDVLLSGGDALLVSDERLEYILKHLREVPHVEIVRIGSRAPVVLPQRITPQLVDMLKKYHPVWLNTHFNHPNEVTEEAVEACERMANAGIPLGNQTVLLRGINDCTHVMKRLVHLLVKVRVRPYYIYACDLSLGIGHFRTPVSKGIEINENLRGHTSGYAVPTFVVHAPGGGGKIPVAPNYVVSQSPRHVVLRNYEGVITTYTEPEDYHGECDCEDCRVDKHREGVAALSGGQQLALEPPDLARKERRSDKN

SEQ ID NO: 3143 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcggccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacgggaactggtacgtgctcctgaagatatggtagacccacttagtgaagatgaagattcgcccgtacccggactgactcatcgttatccggatcgtgtattgttccttatcacggacaaatgttcgatgtactgtcgtcgttgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattaccgaaaatttgcgcggacacacctcgggctatgcagttcctacctttgtggtacatgctccggggggtggtggtaagatacctgtggcgccgaactatgttgtatctcagtccccacgacgtgtggttcttcgcaattatgaaggtgttatcacaacctatacggagccggaggactatcatggggagtgcgattgtgaggactgccgagccgacaagcatcgtgagggcgtggctgcactttccggaggtcagcagttggctttagagcctcccgacttagctcgcaaagaacgcaggagcgataggaactaa

SEQ ID NO: 3144 - protein, 416 aa, Artificial Sequence
  Description of Artificial Sequence: Synthetic Construct
MAESRRKHYFPDVTDEQWYDWHWQVINRIKTLGQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRRCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEITENLRGHTSGYAVPTFVVHAPGGGGKIPVAPNYVVSQSPRRVVLRNYEGVITTYTEPEDYHGECDCEDCRADKHREGVAALSGGQQLALEPPDLARKERRSDRN

SEQ ID NO: 3145 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgccgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattaccgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatggggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3146 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEITENLRGHTSGYAVPTFVVHAPGGGGKIPVAPNYVVSQSPRHVVLRNYEGVITTYTEPEDYHGECDCEDCRVDKHREGVAALSGGQQLALEPPDLARKKRRSDKN

SEQ ID NO: 3147 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcgttgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaaattaccgaagaagcagtggaggcttgtgaaagaatggccaatgccggtattccgttgggtaaccaaacggttttattgcgtggaatcaatgattgtacacatgtgatgaagagattggtacatttgctggtgaagattcgtgtgcgtccttactatatatatgcttgcgatctttcgcttggaatagggcatttccgcacgccggtatctaaaggaatcgaaattaacgaaaatttgcgcggacacacctcgggctatgcagttcctacctttgtggtacatgctccggggggtggtggtaagatacctgtggcgccgaactatgttgtatctcagtccccacgacatgtggttcttcgcaattatgaaggtgttaccacaacctatacggagccggaggactatcatgaggagtgcgattgtgaggactgccgagtcggcaagcatcgtgagggcgtggctgcactttccggaggtcagcagttggctttagagcctcccgacttagctcgcaaaaaacgcaggagcgataggaactaa

SEQ ID NO: 3148 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRRCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEITEEAVEACERMANAGIPLGNQTVLLRGINDCTHVMKRLVHLLVKIRVRPYYIYACDLSLGIGHFRTPVSKGIEINENLRGHTSGYAVPTFVVHAPGGGGKIPVAPNYVVSQSPRHVVLRNYEGVTTTYTEPEDYHEECDCEDCRVGKHREGVAALSGGQQLALEPPDLARKKRRSDRN

SEQ ID NO: 3149 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacgggaactggtacgtgctcctgaagatatggtagacccacttagtgaagatgaagattcgcccgtacccggactgactcatcgttatccggatcgtgtattgttccttatcacggacaaatgttcgatgtactgtcgtcgttgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcatctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagattcgtgtgcgtccttactatatatatgcttgcgatctttcgcttggaatagggcatttccgcacgccggtatctaaaggaatcgaaattaacgaaaatttgcgcggacacacctcgggctatgcagttcctacctttgtggtacatgctccggggggtggtggtaagatacctgtagcgccgaactatgttgtatctcagtccccacgacgtgtggttcttcgcaattatgaaggtgttatcacaacctatacggagccggaggactatcatgaggagtgcgattgtgaggactgccgagtcggcaagcatcgtgagggcgtggctgcactttccggaggtcagcagttggctttagagcctcccgacttagctcgcaaaaaacgcaggagcgataagaactaa

SEQ ID NO: 3150 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRRCTRRRFAGQRDASSPSERIDRCIEYIANTPTVRDVLLSGGDALLVSDERLEYILKHLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEINENLRGHTSGYAVPTFVVHAPGGGGKIPVAPNYVVSQSPRRVVLRNYEGVITTYTEPEDYHEECDCEDCRVGKHREGVAALSGGQQLALEPPDLARKKRRSDKN

SEQ ID NO: 3151 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacgggaactggtacgtgctcctgaagatatggtagacccacttagtgaagatgaagattcgcccgtacccggactgactcatcgttatccggatcgtgtattgttccttatcacggacaaatgttcgatgtactgtcgtcgttgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcatctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattaacgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatggggagtgcgattgtgaggactgccgagtcgacaagcatcgtgagggcgtggctgcactttccggaggtcagcagttggctttagagcctcccgacttagctcgcaaagaacgcaggagcgataggaactaa

SEQ ID NO: 3152 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRRCTRRRFAGQRDASSPSERIDRCIEYIANTPTVRDVLLSGGDALLVSDERLEYILKHLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEINENLRGHTSGYAVPTFVVHAPGGGGKIPVAPNYVVSQSPRHVVLRNYEGVITTYTEPEDYHGECDCEDCRVDKHREGVAALSGGQQLALEPPDLARKERRSDRN

SEQ ID NO: 3153 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgtcgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttaccacaacctatacggagccggaggactatcatgaggagtgcgattgtgaggactgccgagtcggcaagcatcgtgagggcgtggctgcactttccggaggtcagcagttggctctagagcctcccgacttagctcgcaaagaacgcaggagcgataagaactaa

SEQ ID NO: 3154 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVTTTYTEPEDYHEECDCEDCRVGKHREGVAALSGGQQLALEPPDLARKERRSDKN

SEQ ID NO: 3155 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgccgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtggcgccgaactatgttgtatctcagtccccacgacgtgtgattcttcgcaattatgaaggtgttatcacaacctatacggagccggaggactatcatggggagtgcgattgtgaggactgccgagccgacaagcatcgtgagggcgtggctgcactttccggaggtcagcagttggctttagagcctcccgacttagctcgcaaagaacgcaggagcgataagaactaa

SEQ ID NO: 3156 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEIIENLRGHTSGYAVPTFVVHAPGGGGKIPVAPNYVVSQSPRRVILRNYEGVITTYTEPEDYHGECDCEDCRADKHREGVAALSGGQQLALEPPDLARKERRSDKN

SEQ ID NO: 3157 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcggccagctggagaagtacgttacactcaccgctgaagaagaagagggagtagaagaatcgcccaaagtactccgaatggctatcacaccttattatttgagtttgatagaccccgagaatcctaattgtccgattcgtaaacaagccattcctactcgccgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgacgttttgctatcgggaggcgatgccctccttgtcagcgacgaacgcttggaatacatattgaagcatctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagattcgtgtgcgtccttactatatatatgcttgcgatctttcgcttggaatagggcatttccgcacgccggtatctaaaggaatcgaaattaacgaaaatttgcgcggacacacctcgggctatgcagttcctacctttgtggtacatgctccggggggtggtggtaagatacctgtagcgccgaactatgttgtatctcagtccccacgacatgtggctcttcgcaattatgaaggtgttatcacaacctatacggagccggaggactatcatggggagtgcgattgtgaggactgccgagtcggcaagcatcgtgagggcgtggctgcactttccggaggtcagcagttggctttagagcctcccgacttagctcgcaaagaacgcaggagcgataggaactaa

SEQ ID NO: 3158 - protein, 416 aa, Artificial Sequence
  Description of Artificial Sequence: Synthetic Construct
MAESRRKHYFPDVTDEQWYDWHWQVINRIKTLGQLEKYVTLTAEEEEGVEESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKHLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEINENLRGHTSGYAVPTFVVHAPGGGGKIPVAPNYVVSQSPRHVALRNYEGVITTYTEPEDYHGECDCEDCRVGKHREGVAALSGGQQLALEPPDLARKERRSDRN

SEQ ID NO: 3159 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgtcgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcatctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtgaagatgcgtgtgcgtccttactatatatatgcttgcgatctttcgcttggaatagggcatttccgcacgccggtatctaaaggaatcgaaattaacgaaaatttgcgcggacacacctcgggctatgcagttcctacctttgtggtacatgctccggggggtggtggtaagatacctgtggcgccgaactatgttgtatctcagtccccacgacgtgtggttcttcgcaattatgaaggtgtgatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggagcgataggaactaa

SEQ ID NO: 3160 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKHLREVPHVEIVRIGSRAPVVLPQRITPQLVDMLKKYHPVWLNTHFNHPNEVTEEAVEACERMANAGIPLGNQTVLLRGINDCTHVMKRLVHLLVKMRVRPYYIYACDLSLGIGHFRTPVSKGIEINENLRGHTSGYAVPTFVVHAPGGGGKIPVAPNYVVSQSPRRVVLRNYEGVITTYTEPEDYHEECDCEDCRVDKHREGVAALSGGQQLALEPPDLARKKRRSDRN

SEQ ID NO: 3161 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgtcgggaactggtacgtgctcctgaagatatggtagacccacttagtgaagatgaagattcgcccgtacccggactgactcgtcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaataccatccggtgtggctgaacactcacttcaaccacccgaatgaagttaccgaagaagcagtggaggcttgtgaaagaatggccaatgccggtattccgttgggtgaccaaacggttttattgcgtggaatcaatgattgtacacatgtgatgaagagattggtacatttgctggtgaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtggcgccgaactatgttgtatctcagtccccacgacatgtggttcttcgcaattatgaaggtgttatcacaacctatacggagccggaggactatcatggggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3162 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTRRELVRAPEDMVDPLSEDEDSPVPGLTRRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGDQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHGECDCEDCRVDKHREGVAALSGGQQLALEPPDLARKERRSDKN

SEQ ID NO: 3163 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgtcgggaactggtacgtgctcctgaagatatggtagacccacttagtgaagatgaagattcgcccgtacccggactgactcatcgttatccggatcgtgtattgttccttatcacggacaaatgttcgatgtactgtcgtcgttgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcatctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattaccgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatggggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3164 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRRCTRRRFAGQRDASSPSERIDRCIEYIANTPTVRDVLLSGGDALLVSDERLEYILKHLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEITENLRGHTSGYAVPTFVVHAPGGGGKIPVAPNYVVSQSPRHVVLRNYEGVITTYTEPEDYHGECDCEDCRVDKHREGVAALSGGQQLALEPPDLARKERRSDKN

SEQ ID NO: 3165 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaggacgctcgaccagctggagaagtacgttacactcaccgctgaagaagaagagggagtaaaagaatcgcccaaagtactccgaatggctatcacaccttattatttgagtttgataaaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcggagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtgggggcttgtggaggaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccgatatctaaaggaatcgaaattatcgaaaatttgcgcggacacacctcgggctatgcagttcctacctttgtgatacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggttttagagcctcccgacttagctcgcaaaaaacgcaggagcgataagaactaa

SEQ ID NO: 3166 - protein, 416 aa, Artificial Sequence
  Description of Artificial Sequence: Synthetic Construct
MAESRRKYYFPDVTDEQWYDWHWQVINRIRTLDQLEKYVTLTAEEEEGVKESPKVLRMAITPYYLSLINPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLRGVPHVEIVRIGSRAPVVLPQRITPQLVDMLKKYHPVWLNTHFNHPNEVTEEAVGACGGMANAGIPLGNQTVLLRGINDCTHVMKRLVHLLVKIRVRPYYIYACDLSLGIGHFRTPISKGIEIIENLRGHTSGYAVPTFVIHAPGGGGKIPVAPNYVVSQSPRHVVLRNYEGVITTYTEPEDYHEECDCEDCRVDKHREGVAALSGGQQLVLEPPDLARKKRRSDKN

SEQ ID NO: 3167 - DNA, 1251 bp, Artificial Sequence
  Description of Artificial Sequence: Synthetic Construct
atggcagaaagtcgtagaaagtattatttccctgatgtcaccgatgagcaatggtgcgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtgggggcttgtggaagaatggccaatgccggtattccgttgggtaaccaaacggttttattgcgtggaatcaatggttgtacacatgtgatgaagagattggtacatttgctggtaaagattcgtgtgcgtccttactatatatatgcttgcgatctttcgcttggaatagggcatttccgcacgccgatatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgaactttccggaggtcagcagttggttttagagcctcccgacttagctcgcaaaaaacgcaggagcgataagaactaa

SEQ ID NO: 3168 - protein, 416 aa, Artificial Sequence
  Description of Artificial Sequence: Synthetic Construct
MAESRRKYYFPDVTDEQWCDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVGACGRMANAGIPLGNQTVLLRGINGCTHVMKRLVHLLVKIRVRPYYIYACDLSLGIGHFRTPISKGIEIIENLRGHTSGYAVPTFVVHAPGGGGKIPVAPNYVVSQSPRHVVLRNYEGVITTYTEPEDYHEECDCEDCRVDKHREGVAELSGGQQLVLEPPDLARKKRRSDKN

SEQ ID NO: 3169 - DNA, 1251 bp, Artificial Sequence
  Description of Artificial Sequence: Synthetic Construct
atggcagaaagtcgtagaaagtattatttccctgatgtcaccgatgagcaatggtgcgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgataaaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaggtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtggaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatggggagtgcgattgtgaggactgccgagtcgacaagcatcgtgagggcgtggctgcactttccggaggtcagcagttggttttagagcctcccgacttagctcgcaaaaaacgcaggagcgataagaactaa

SEQ ID NO: 3170 - protein, 416 aa, Artificial Sequence
  Description of Artificial Sequence: Synthetic Construct
MAESRRKYYFPDVTDEQWCDWHWQVINRIKTLDQLEKYVTLTAEEEEGVKESPKVLRMAITPYYLSLINPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACGRMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHGECDCEDCRVDKHREGVAALSGGQQLVLEPPDLARKKRRSDKN

SEQ ID NO: 3171 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgataaaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcggagtacctcatgtggagattgttcgtataggaagccgtgcgccggtagtcctccctcagcgtataacgcctcaattggtggatatgctcaaaaaatatcatccggtgtggccgaacactcacttcaaccacccgagtgaagttaccgaagaagcagtggaggcttgtgaaggaatggccaatgccggtattccgttgggtaaccaaacggttttattgcgtggaatcaatggttgtacacatgtgatgaagagattggtacatttgctggtaaagattcgtgtgcgtccttactatatatatgcttgcgatctttcgcttggaatagggcatttccgcacgccgatatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgaactttccggaggtcagcagttggctttagagcctcccgacttagctcgcaaaaaacgcaggagcgataagaactaa

SEQ ID NO: 3172 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLINPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLRGVPHVEIVRIGSRAPVVLPQRITPQLVDMLKKYHPVWPNTHFNHPSEVTEEAVEACEGMANAGIPLGNQTVLLRGINGCTHVMKRLVHLLVKIRVRPYYIYACDLSLGIGHFRTPISKGIEIIENLRGHTSGYAVPTFVVHAPGGGGKIPVAPNYVVSQSPRHVVLRNYEGVITTYTEPEDYHEECDCEDCRVDKHREGVAELSGGQQLALEPPDLARKKRRSDKN

SEQ ID NO: 3173 - DNA, 1251 bp, Artificial Sequence
  Description of Artificial Sequence: Synthetic Construct
atggcagaaagtcgtagaaagtattatttccctgatgtcaccaatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgataaaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcatagtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcggagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccgatatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgaactttccggaggtcagcagttggctttagagcctcccgacttagctcgcaaaaaacgcaggagcgataagaactaa

SEQ ID NO: 3174 - protein, 416 aa, Artificial Sequence
  Description of Artificial Sequence: Synthetic Construct
MAESRRKYYFPDVTNEQWYDWHWQVINRIKTLDQLEKYVTLTAEEEEGVKESPKVLRMAITPYYLSLINPENPNCPIRKQAIPTKRELVRAPEDMVDPLSEDEDSPVPGLTHRYPDRVLFLITDKCSMYCRHSTRRRFAGQRDASSPSERIDRCIEYIANTPTVRDVLLSGGDALLVSDERLEYILKRLRGVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPISKGIEIIENLRGHTSGYAVPTFVVHAPGGGGKIPVAPNYVVSQSPRHVVLRNYEGVITTYTEPEDYHEECDCEDCRVDKHREGVAELSGGQQLALEPPDLARKKRRSDKN

SEQ ID NO: 3175 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaggacgctcgaccagctggagaagtacgttacactcaccgctggggaagaagggggagtaaaagaatcgcccaaagtactccgaatggctatcacaccttattatttgagtttgataaaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcggagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtgggggcttgtgaaagaatggccaatgccggtattccgttgggtaaccaaacggttttattgcgtggaatcaatggttgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggttttagagcctcccgacttagctcgcaaaaaacgcaggagcgataagaactaa

SEQ ID NO: 3176 - protein, 416 aa, Artificial Sequence
  Description of Artificial Sequence: Synthetic Construct
MAESRRKYYFPDVTDEQWYDWHWQVINRIRTLDQLEKYVTLTAGEEGGVKESPKVLRMAITPYYLSLINPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLRGVPHVEIVRIGSRAPVVLPQRITPQLVDMLKKYHPVWLNTHFNHPNEVTEEAVGACERMANAGIPLGNQTVLLRGINGCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLVLEPPDLARKKRRSDKN

SEQ ID NO: 3177 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaggaagaagggggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtggagatgaagattcgcccgtacccggactgactcatcgttatccggatcgtgtattgttccttgtcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcggagtacctcatgtggagattgttcgtataggaagccgtgcgccggtagtcctccctcagcgtatgacgcctcgattggtggatatgctcaaaaaatatcatccggtgtggctgaacactcacttcaaccacccgaatgaagttaccgaagaagcagtgggggcttgtgaaagaatggccaatgccggtattccgttgggtaaccaaacggttttattgcgtggaatcaatggttgtacacatgtgatgaagagattggtacatttgctggtaaagattcgtgtgcgtccttactatatatatgcttgcgatctttcgcttggaatagggcatttccgcacgccgatatctaaaggaatcgaaattatcgaaaacttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggttttagagcctcccgacttagctcgcaaaaaacgcaggagcgataagaactaa

SEQ ID NO: 3178 - protein, 416 aa, Artificial Sequence
  Description of Artificial Sequence: Synthetic Construct
MAESRRKYYFPDVTDEQWYDWHWQVINRIKTLDQLEKYVTLTAEEEGGVKESPKVLRMAITPYYLSLIDPENPNCPIRKQAIPTKRELVRAPEDMVDPLSGDEDSPVPGLTHRYPDRVLFLVTDKCSMYCRHCTRRRFAGQRDASSPSERIDRCIEYIANTPTVRDVLLSGGDALLVSDERLEYILKRLRGVPHVEIVRIGSRAPVVLPQRMTPRLVDMLKKYHPVWLNTHFNHPNEVTEEAVGACERMANAGIPLGNQTVLLRGINGCTHVMKRLVHLLVKIRVRPYYIYACDLSLGIGHFRTPISKGIEIIENLRGHTSGYAVPTFVVHAPGGGGKIPVAPNYVVSQSPRHVVLRNYEGVITTYTEPEDYHEECDCEDCRVDKHREGVAALSGGQQLVLEPPDLARKKRRSDKN

SEQ ID NO: 3179 - DNA, 1251 bp, Artificial Sequence
  Description of Artificial Sequence: Synthetic Construct
atggcagaaagtcgtagaaagtattatttccctgatgtcaccgatgagcaatggtgcgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgataaaccccgagaatcctaattgtccgattcgtaaacaagccattcctactaaacgggaactggtacgtgctcctgaagatatggtagagccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcggagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaggaatggccaatgccggtataccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccgatatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgaactttccggaggtcagcagttggctttagagcctcccgacttagctcgcaaaaaacgcaggagcgataagaactaa

SEQ ID NO: 3180 - protein, 416 aa, Artificial Sequence
  Description of Artificial Sequence: Synthetic Construct
MAESRRKYYFPDVTDEQWCDWHWQVINRIKTLDQLEKYVTLTAEEEEGVKESPKVLRMAITPYYLSLINPENPNCPIRKQAIPTKRELVRAPEDMVEPLSEDEDSPVPGLTHRYPDRVLFLITDKCSMYCRHCTRRRFAGQRDASSPSERIDRCIEYIANTPTVRDVLLSGGDALLVSDERLEYILKRLRGVPHVEIVRIGSRAPVVLPQRITPQLVDMLKKYHPVWLNTHFNHPNEVTEEAVEACEGMANAGIPLGNQTVLLRGINDCTHVMKRLVHLLVKIRVRPYYIYACDLSLGIGHFRTPISKGIEIIENLRGHTSGYAVPTFVVHAPGGGGKIPVAPNYVVSQSPRHVVLRNYEGVITTYTEPEDYHEECDCEDCRVDKHREGVAELSGGQQLALEPPDLARKKRRSDKN

SEQ ID NO: 3181 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatttgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccgggggtcagcagttggctttagagcctcccgacttagctcgcaaaaaacgcaggagcgataagaactaa

SEQ ID NO: 3182 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIFACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKKRRSDKN

SEQ ID NO: 3183 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatataatggcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3184 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIMACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKKRRSDKN

SEQ ID NO: 3185 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatttgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3186 - protein, 416 aa, Artificial Sequence; identical to SEQ ID NO: 3182
  Description of Artificial Sequence: Synthetic Construct

SEQ ID NO: 3187 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacttatacggagccggaggaccatcatgaggagtgcgattgtgaggactgccgagtcgacaagcatcgcgagggcgtggctgcactttccggaggtcagcagttggctttagagcctcccgacttagctcgcaaaaaacgcaggagcgataagaactaa

SEQ ID NO: 3188 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDHHEECDCEDCRVDKHREGVAALSGGQQLALEPPDLARKKRRSDKN

SEQ ID NO: 3189 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaaatacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaagggattatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3190 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREIPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGIITTYTEPEDYHEECDCEDCRVDKHREGVAALSGGQQLALEPPDLARKKRRSDKN

SEQ ID NO: 3191 - DNA, 1251 bp, Artificial Sequence
  Description of Artificial Sequence: Synthetic Construct
atggcagaaagtcgcagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggggttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3192 - protein, 416 aa, Artificial Sequence; identical to SEQ ID NO: 2578
  Description of Artificial Sequence: Synthetic Construct

SEQ ID NO: 3193 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaggaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcatttggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggggcgataagaactaa

SEQ ID NO: 3194 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPHLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKKRRGDKN

SEQ ID NO: 3195 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggcgttagagactcccgacttagctcgcaaaaaacgcaggagcgataagaactaa

SEQ ID NO: 3196 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALETPDLARKKRRSDKN

SEQ ID NO: 3197 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggcgttagagcttcccgacttagctcgcaaaaaacgcaggagcgataagaactaa

SEQ ID NO: 3198 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALELPDLARKKRRSDKN

SEQ ID NO: 3199 - DNA, 1251 bp, Artificial Sequence
  Description of Artificial Sequence: Synthetic Construct
atggcagagagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggcgttagagggtcccgacttagctcgcaaaaaacgtaggagcgataagaactaa

SEQ ID NO: 3200 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEGPDLARKKRRSDKN

SEQ ID NO: 3201 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggcgttagagatgcccgacttagctcgcaaaaaacgcaggagcgataagaactaa

SEQ ID NO: 3202 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEMPDLARKKRRSDKN

SEQ ID NO: 3203 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggcgttagagattcccgacttagctcgcaaaaaacgcaggagcgataagaactaa

SEQ ID NO: 3204 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEIPDLARKKRRSDKN

SEQ ID NO: 3205 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttctgacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3206 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVLTTYTEPEDYHEECDCEDCRVDKHREGVAALSGGQQLALEPPDLARKKRRSDKN

SEQ ID NO: 3207 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctatggagcctcccgacttagctcgcaaaaaacgcaggagcgataagaactaa

SEQ ID NO: 3208 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLAMEPPDLARKKRRSDKN

SEQ ID NO: 3209 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcggtgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtataccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgccgtttccggaggtcagcagttggctattgagcctcccgacttagctcgcaaaaaacgcaggagcgataagaactaa

SEQ ID NO: 3210 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAAVSGGQQLAIEPPDLARKKRRSDKN

SEQ ID NO: 3211 - DNA, 1251 bp, Artificial Sequence
  Description of Artificial Sequence: Synthetic Construct
atggcagaaagtcgtagaaagtattatttccctgatgtccccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3212 - protein, 416 aa, Artificial Sequence
  Description of Artificial Sequence: Synthetic Construct
MAESRRKYYFPDVPDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKKRRSDKN

SEQ ID NO: 3213 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggttgtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgccgtttccggaggtcagcagttggctttagagcctcccgacttagctcgcaaaaaacgcaggagcgataagaactaa

SEQ ID NO: 3214 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGCGKIPVAPNYVVSQSPRHVVLRNYEGVITTYTEPEDYHEECDCEDCRVDKHREGVAAVSGGQQLALEPPDLARKKRRSDKN

SEQ ID NO: 3215 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgcgcgtccttactatatagcggcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3216 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRARPYYIAACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKKRRSDKN

SEQ ID NO: 3217 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatacaggcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggattgccgagtcgacaagcatcgtgagggcgtggctgcactttccggaggtcagcagttggctttagagcctcccgacttagctcgcaaaaaacgcaggagcgataagaactaa

SEQ ID NO: 3218 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIQACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKKRRSDKN

SEQ ID NO: 3219 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatataactgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3220 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYITACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKKRRSDKN

SEQ ID NO: 3221 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatataagtgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3222 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYISACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKKRRSDKN

SEQ ID NO: 3223 - DNA, 1251 bp, Artificial Sequence
  Description of Artificial Sequence: Synthetic Construct
atggcagaaagtcgtagaaagtattacttccctgatgtcaccgatgagcaatggtacgactggcattggcaggtcatcaatcgaattaagacactcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacggacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatgtgcttgcgatctttcgcttggaatagggcatttccgcacgccggtatctaaaggaatcgaaattatcgaaaatttgcgcggacacacctcgggccatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3224 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDGRLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYICACDLSLGIGHFRTPVSKGIEIIENLRGHTSGHAVPTFVVHAPGGGGKIPVAPNYVVSQSPRHVVLRNYEGVITTYTEPEDYHEECDCEDCRVDKHREGVAALSGGQQLALEPPDLARKKRRSDKN

SEQ ID NO: 3225 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagaggttggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctacgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggcgttagagttgcccgacttagctcgcaaaaaacgcaggagcgataagaactaa

SEQ ID NO: 3226 - protein, 416 aa, Artificial Sequence; identical to SEQ ID NO: 3198
  Description of Artificial Sequence: Synthetic Construct

SEQ ID NO: 3227 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccgaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggcgttagagcggcccgacttagctcgcaaaaaacgcaggagcgataagaactaa

SEQ ID NO: 3228 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPEVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALERPDLARKKRRSDKN

SEQ ID NO: 3229 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccactgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtaccgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggcgttagaggggcccgacttagctcgcaaaaaacgcaggagcgataagaactaa

SEQ ID NO: 3230 - protein, 416 aa, Artificial Sequence
  Description of Artificial Sequence: Synthetic Construct
MAESRRKYYFPDVTDEQWYDWHWQVINRIKTLDQLEKYVTLTTEEEEGVKESPKVLRMAITPYYLSLIDPENPNCPIRKQAIPTKRELVRAPEDMVDPLSEDEDSPVPGLTHRYPDRVLFLITDKCSMYRRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEGPDLARKKRRSDKN

SEQ ID NO: 3231 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccccccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3232 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDAPLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKKRRSDKN

SEQ ID NO: 3233 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggcgttagaggagcccgacttagctcgcaaaaaacgcaggagcgataagaactaa

SEQ ID NO: 3234 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEEPDLARKKRRSDKN

SEQ ID NO: 3235 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaactaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcgatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggcgttagagcttcccgacttagctcgcaaaaaacgcaggagcgataagaactaa

SEQ ID NO: 3236 - protein, 416 aa, Artificial Sequence
  Description of Artificial Sequence: Synthetic Construct
MAESRRKYYFPDVTDEQWYDWHWQVINRTKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGIDDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALELPDLARKKRRSDKN

SEQ ID NO: 3237 - DNA, 1251 bp, Artificial Sequence
  Description of Artificial Sequence: Synthetic Construct
atggcagaaagccgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgtaggtgttatcacaacctatacggagccggaggactatcatgaggagtgcgattgtgaggactgccgagtcgacaagcatcgtgagggcgtggctgcactttccggaggtcagcagttggcgttagaggttcccgacttagctcgcaaaaaacgcaggagcgataagaactaa

SEQ ID NO: 3238 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYVGVITTYTEPEDYHEECDCEDCRVDKHREGVAALSGGQQLALEVPDLARKKRRSDKN

SEQ ID NO: 3239 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttacaacaacctatacggagccggaggactatcatgaggagtgcgattgtgaggactgccgagtcgacaagcatcgtgagggcgtggctgcactttccggaggtcagcagttggctattgagcctcccgacttagctcgcaaaaaacgcaggagcgataagaactaa

SEQ ID NO: 3240 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVTTTYTEPEDYHEECDCEDCRVDKHREGVAALSGGQQLAIEPPDLARKKRRSDKN

SEQ ID NO: 3241 - DNA, 1251 bp, Artificial Sequence
  Description of Artificial Sequence: Synthetic Construct
atggcagaaagtcgtagaaagtattatttccctgatgtcaccgatgagcaatggtacgactggcattggcgggtcatcaatcgaattaagacgcccgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttacaacaacctatacggagccggaggactatcatgaggagtgcgattgtgaggactgccgagtcgacaagcatcgtgagggcgtggctgcacttaccggaggtcagcagttggctattgagcctcccgacttagctcgcaaaaaacgcaggagcgataagaactaa

SEQ ID NO: 3242 - protein, 416 aa, Artificial Sequence
  Description of Artificial Sequence: Synthetic Construct
MAESRRKYYFPDVTDEQWYDWHWRVINRIKTPDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVTTTYTEPEDYHEECDCEDCRVDKHREGVAALTGGQQLAIEPPDLARKKRRSDKN

SEQ ID NO: 3243 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttacaacaacctatacggagccggaggactatcatgaggagtgcgattgtgaggactgccgagtcgacaagcatcgtgagggcgtggctgcactttccggaggtcagcagttggctatggagcctcccgacttagctcgcaaaaaacgcaggagcgataagaactaa

SEQ ID NO: 3244 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVTTTYTEPEDYHEECDCEDCRVDKHREGVAALSGGQQLAMEPPDLARKKRRSDKN

SEQ ID NO: 3245 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttacaacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3246 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVTTTYTEPEDYHEECDCEDCRVDKHREGVAALSGGQQLALEPPDLARKKRRSDKN

SEQ ID NO: 3247 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtttgcgcgaagtacctcatgtggagattgttcgtataggaagccgtgcgccggtagtcctccctcagcgtataacgcctcaattggtggatatgctcaaaaaataccatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgctcggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatgacaacctatacggagccggaggactatcatgaggagtgcgattgtgaggactgccgagtcgacaagcatcgtgagggcgtggctgccatgtccggaggtcagcagttggctattgagcctcccgacttagctcgcaaaaaacgcaggagcgataagaactaa

SEQ ID NO: 3248 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVMTTYTEPEDYHEECDCEDCRVDKHREGVAAMSGGQQLAIEPPDLARKKRRSDKN

SEQ ID NO: 3249 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctgttgagcctcccgacttagctcgcaaaaaacgcaggagcgataagaactaa

SEQ ID NO: 3250 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLAVEPPDLARKKRRSDKN

SEQ ID NO: 3251 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacgaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtctccacgacatgtggttcttcgcaattatgaaggtgttacaacaacctatacggagccggaggactatcatgaggagtgcgattgtgaggactgccgagtcgacaagcatcgtgagggcgtggctgccgtgtccggaggtcagcagttggctgtggagcctcccgacttagctcgcaaaaaacgcaggagcgataagaactaa

SEQ ID NO: 3252 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDECSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVTTTYTEPEDYHEECDCEDCRVDKHREGVAAVSGGQQLAVEPPDLARKKRRSDKN

SEQ ID NO: 3253 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgggaatcctaattgtccgattcgtaaacaagccattcctactaaacgggaactggtacgtgctcctgaagatatggtagacccacttagtgaagatgaagattcgcccgtacccggactgactcatcattatccggatcgtgtattgttccttatcacggacaaatgttcgatgtactgtcgtcattgtactcgccgtcgcttcgcaggacagggagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttacaacaacctatacggagccggaggactatcatgaggagtgcgattgtgaggactgccgagtcgacaagcatcgtgagggcgtggctgccgtttccggaggtcagcagttggctgttgagcctcccgacttagctcgcaaaaaacgcaggagcgataagaactaa

SEQ ID NO: 3254 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPGNPNCPIRKQAIPTKRELVRAPEDMVDPLSEDEDSPVPGLTHHYPDRVLFLITDKCSMYCRHCTRRRFAGQGDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVTTTYTEPEDYHEECDCEDCRVDKHREGVAAVSGGQQLAVEPPDLARKKRRSDKN

SEQ ID NO: 3255 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgccgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatggggagtgcgattgtgaggactgccgagtcggcaagcatcgtgagggcgtggctgcactttccggaggtcagcagttggctttagagcctcccgacttagctcgcaaagaacgcaggagcgataagaactaa

SEQ ID NO: 3256 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHGECDCEDCRVGKHREGVAALSGGQQLALEPPDLARKERRSDKN

SEQ ID NO: 3257 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgccgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagccttccgacttagctcgcaaagaacgcaggagcgataagaactaa

SEQ ID NO: 3258 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPSDLARKERRSDKN

SEQ ID NO: 3259 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgacgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3260 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 3261 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtggtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3262 - protein, 416 aa, Artificial Sequence; identical to SEQ ID NO: 3260
  Description of Artificial Sequence: Synthetic Construct

SEQ ID NO: 3263 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaggaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttaccacaacctatacggagccggaggactatcatggggagtgcgattgtgaggactgccgagtcggcaagcatcgtgagggcgtggctgcactttccggaggtcagcagttggctttagagcctcccgacttagctcgcaaaaaacgcaggagcgataagaactaa

SEQ ID NO: 3264 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVTTTYTEPEDYHGECDCEDCRVGKHREGVAALSGGQQLALEPPDLARKKRRSDKN

SEQ ID NO: 3265 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgtcgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatggggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3266 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHGECDCEDCRVDKHREGVAALSGGQQLALEPPDLARKERRSDKN

SEQ ID NO: 3267 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgtcgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgtcatcacaacctatacggagccggaggactatcatggggagtgcgattgtgaggactgccgagccgacaagcatcgtgagggcgtggctgcactttccggaggtcagcagttggctttagagcctcccgacttagctcgcaaagaacgcaggagcgataagaactaa

SEQ ID NO: 3268 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHGECDCEDCRADKHREGVAALSGGQQLALEPPDLARKERRSDKN

SEQ ID NO: 3269 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgagcgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatggggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3270 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHGECDCEDCRVDKHREGVAALSGGQQLALEPPDLARKERRSDKN

SEQ ID NO: 3271 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgtcgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcctcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggaggttgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtgattcttcgcaattatgaaggtgttatcacaacctatacggagccggaggactatcatgaggagtgcgattgtgaggactgccgagtcgacaagcatcgtgagggcgtggctgcgctttccggaggtcagcagttggctttagagcctcccgacttagctcgcaaaaaacgcaggagcgataagaactaa

SEQ ID NO: 3272 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEVVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVILRNYEGVITTYTEPEDYHEECDCEDCRVDKHREGVAALSGGQQLALEPPDLARKKRRSDKN

SEQ ID NO: 3273 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3274 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 3275 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacgtgtggttcttcgcaattatgaaggtgttatcacaacctatacggagccggaggactatcatggggagtgcgattgtgaggactgccgagtcggcaagcatcgtgagggcgtggctgcactttccggaggtcagcagttggctttagagcctcccgacttagctcgcaaagaacgcaggagcgatgagaactaa

SEQ ID NO: 3276 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRRVVLRNYEGVITTYTEPEDYHGECDCEDCRVGKHREGVAALSGGQQLALEPPDLARKERRSDEN

SEQ ID NO: 3277 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttaccacaacctatacggagccggaggactatcatggggagtgcgattgtgaggactgccgagccggcaagcatcgtgagggcgtggctgcactttccggaggtcagcagttggctttagagcctcccgacttagctcgcaaagaacgcaggagcgataagaactaa

SEQ ID NO: 3278 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVTTTYTEPEDYHGECDCEDCRAGKHREGVAALSGGQQLALEPPDLARKERRSDKN

SEQ ID NO: 3279 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagccgacaagcatcgtgagggcgtggctgcactttccggaggtcagcagttggctttagagcctcccgacttagctcgcaaaaaacgcaggagcgataagaactaa

SEQ ID NO: 3280 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRADKHREGVAALSGGQQLALEPPDLARKKRRSDKN

SEQ ID NO: 3281 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcggccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgtcgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtgattcttcgcaattatgaaggtgttatcacaacctatacggagccggaggactatcatggggagtgcgattgtgaggactgccgagtcggcaagcatcgtgagggcgtggctgcactttccggaggtcggcagttggctttagagcctcccgacttagctcgcaaagaacgcaggagcgataagaactaa

SEQ ID NO: 3282 - protein, 416 aa, Artificial Sequence
  Description of Artificial Sequence: Synthetic Construct
MAESRRKHYFPDVTDEQWYDWHWQVINRIKTLGQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVILRNYEGVITTYTEPEDYHGECDCEDCRVGKHREGVAALSGGRQLALEPPDLARKERRSDKN

SEQ ID NO: 3283 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcggccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgccgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgccacaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagccggcaagcatcgtgagggcgtggctgcactttccggaggtcagcagttggctttagagcctcccgacttagctcgcaaagaacgcaggagcgataagaactaa

SEQ ID NO: 3284 - protein, 416 aa, Artificial Sequence
  Description of Artificial Sequence: Synthetic Construct
MAESRRKHYFPDVTDEQWYDWHWQVINRIKTLGQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRAGKHREGVAALSGGQQLALEPPDLARKERRSDKN

SEQ ID NO: 3285 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgtattaagacgctcggccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgtcgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacgtgtggttcttcgcaattatgaaggtgttatcacaacctatacggagccggaggactatcatggggagtgcgattgtgaggactgccgagccggcaagcatcgtgagggcgtggctgcactttccggaggtcagcagttggctttagagcctcccgacttagctcgcaaagaacgcaggagcgataagaactaa

SEQ ID NO: 3286 - protein, 416 aa, Artificial Sequence
  Description of Artificial Sequence: Synthetic Construct
MAESRRKHYFPDVTDEQWYDWHWQVINRIKTLGQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRRVVLRNYEGVITTYTEPEDYHGECDCEDCRAGKHREGVAALSGGQQLALEPPDLARKERRSDKN

SEQ ID NO: 3287 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcggccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttaccacaacctatacggagccggaggactatcatgaggagtgcgattgtgaggactgccgagtcggcaagcatcgtgagggcgtggctgcactttccggaggtcagcagttggctttagagcctcccgacttagctcgcaaaaaacgcaggagcgataagaactaa

SEQ ID NO: 3288 - protein, 416 aa, Artificial Sequence
  Description of Artificial Sequence: Synthetic Construct
MAESRRKHYFPDVTDEQWYDWHWQVINRIKTLGQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVTTTYTEPEDYHEECDCEDCRVGKHREGVAALSGGQQLALEPPDLARKKRRSDKN

SEQ ID NO: 3289 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtgttccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttaccacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3290 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGVPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVTTTYTEPEDYHEECDCEDCRVDKHREGVAALSGGQQLALEPPDLARKKRRSDKN

SEQ ID NO: 3291 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgccgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3292 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 3293 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcggccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3294 - protein, 416 aa, Artificial Sequence
  Description of Artificial Sequence: Synthetic Construct
MAESRRKHYFPDVTDEQWYDWHWQVINRIKTLGQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 3295 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcggccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatggggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3296 - protein, 416 aa, Artificial Sequence
  Description of Artificial Sequence: Synthetic Construct
MAESRRKHYFPDVTDEQWYDWHWQVINRIKTLGQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHGECDCEDCRVDKHREGVAALSGGQQLALEPPDLARKERRSDKN

SEQ ID NO: 3297 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcggccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgccgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtgattcttcgcaattatgaaggtgttaccacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3298 - protein, 416 aa, Artificial Sequence
  Description of Artificial Sequence: Synthetic Construct
MAESRRKHYFPDVTDEQWYDWHWQVINRIKTLGQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVILRNYEGVTTTYTEPEDYHEECDCEDCRVDKHREGVAALSGGQQLALEPPDLARKKRRSDKN

SEQ ID NO: 3299 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgtcgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagcgattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3300 - protein, 416 aa, Artificial Sequence; identical to SEQ ID NO: 3274
  Description of Artificial Sequence: Synthetic Construct

SEQ ID NO: 3301 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgagaactggtacatgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatggggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3302 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVHAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHGECDCEDCRVDKHREGVAALSGGQQLALEPPDLARKERRSDKN

SEQ ID NO: 3303 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttaccacaacctatacggagccggaggactatcatgaggagtgcgattgtgaggactgccgagccgacaagcatcgtgagggcgtggctgcactttccggaggtcagcagttggctttagagcctcccgacttagctcgcaaagaacgcaggagcgataagaactaa

SEQ ID NO: 3304 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVTTTYTEPEDYHEECDCEDCRADKHREGVAALSGGQQLALEPPDLARKERRSDKN

SEQ ID NO: 3305 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgccgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgtgtcgacaagcatcgtgagggcgtggctgcactttccggaggtcagcagttggctttagagcctcccgacttagctcgcaaagaacgcaggagcgataagaactaa

SEQ ID NO: 3306 - protein, 416 aa, Artificial Sequence; identical to SEQ ID NO: 3274
  Description of Artificial Sequence: Synthetic Construct

SEQ ID NO: 3307 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcggccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgtcgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccggactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3308 - protein, 416 aa, Artificial Sequence
  Description of Artificial Sequence: Synthetic Construct
MAESRRKHYFPDVTDEQWYDWHWQVINRIKTLGQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPDYVVSQSPRHVVLRNYEGVITTYTEPEDYHEECDCEDCRVDKHREGVAALSGGQQLALEPPDLARKERRSDKN

SEQ ID NO: 3309 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacgtgtggttcttcgcaattatgaaggtgttatcacaacctatacggagccggaggactatcatggggagtgcgattgtgaggactgccgagtcgacaagcatcgtgagggcgtggctgcactttccggaggtcagcagttggctttagagcctcccgacttagctcgcaaagaacgcaggagcgataagaaataa

SEQ ID NO: 3310 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRRVVLRNYEGVITTYTEPEDYHGECDCEDCRVDKHREGVAALSGGQQLALEPPDLARKERRSDKK

SEQ ID NO: 3311 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcggccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgtcgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggccgcactttccggaggtcagcagttggctttagagcctcccgacttagctcgcaaagaacgcaggagcgataagaactaa

SEQ ID NO: 3312 - protein, 416 aa, Artificial Sequence
  Description of Artificial Sequence: Synthetic Construct
MAESRRKHYFPDVTDEQWYDWHWQVINRIKTLGQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 3313 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacgggaactggtacgtgctcctgaagatatggtagacccacttagtgaagatgaagattcgcccgtacccggactaactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatggggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3314 - protein, 416 aa, Artificial Sequence; identical to SEQ ID NO: 3266
  Description of Artificial Sequence: Synthetic Construct

SEQ ID NO: 3315 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcggccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagccgacaagcatcgtgagggcgtggctgcactttccggaggtcagcagttggctttagagcctcccgacttagctcgcaaagaacgcaggagcgataagaactaa

SEQ ID NO: 3316 - protein, 416 aa, Artificial Sequence
  Description of Artificial Sequence: Synthetic Construct
MAESRRKHYFPDVTDEQWYDWHWQVINRIKTLGQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRADKHREGVAALSGGQQLALEPPDLARKERRSDKN

SEQ ID NO: 3317 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgtcgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttaccacaacctatacggagccggaggactatcatgaggagtgcgattgtgaggactgccgagtcgacaagcatcgtgagggcgtggctgcactatccggaggtcagcagttggctttagagcctcccgacttagctcgcaaagaacgcaggagcgataagaactaa

SEQ ID NO: 3318 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVTTTYTEPEDYHEECDCEDCRVDKHREGVAALSGGQQLALEPPDLARKERRSDKN

SEQ ID NO: 3319 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcggccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3320 - protein, 416 aa, Artificial Sequence
  Description of Artificial Sequence: Synthetic Construct
MAESRRKHYFPDVTDEQWYDWHWQVINRIKTLGQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKKRRSDKN

SEQ ID NO: 3321 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcggccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatggggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3322 - protein, 416 aa, Artificial Sequence
  Description of Artificial Sequence: Synthetic Construct
MAESRRKHYFPDVTDEQWYDWHWQVINRIKTLGQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHGECDCEDCRVDKHREGVAALSGGQQLALEPPDLARKKRRSDKN

SEQ ID NO: 3323 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgccgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatggggagtgcgattgtgaggactgccgagccggcaagcatcgtgagggcgtggctgcactttccggaggtcagcagttggctttagagcctcccgacttagctcgcaaagaacgcaggagcgataagaactaa

SEQ ID NO: 3324 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHGECDCEDCRAGKHREGVAALSGGQQLALEPPDLARKERRSDKN

SEQ ID NO: 3325 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcggccagctggagaagtacgttacactcaccgctgatgaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgcccgtagtcctccctcagcgtataacgcctcaattggtggatatgctcaaaaaatatcacccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatggggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3326 - protein, 416 aa, Artificial Sequence
  Description of Artificial Sequence: Synthetic Construct
MAESRRKHYFPDVTDEQWYDWHWQVINRIKTLGQLEKYVTLTADEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHGECDCEDCRVDKHREGVAALSGGQQLALEPPDLARKERRSDKN

SEQ ID NO: 3327 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtgattcttcgcaattatgaaggtgttatcacaacctatacggagccggaggactatcatggggagtgcgattgtgaggactgccgagccggcaagcatcgtgagggcgtggctgcactttccggaggtcagcagttggctttagagcctcccgacttagctcgcaaagaacgcaggagcgataagaactaa

SEQ ID NO: 3328 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVILRNYEGVITTYTEPEDYHGECDCEDCRAGKHREGVAALSGGQQLALEPPDLARKERRSDKN

SEQ ID NO: 3329 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagccgacaagcatcgtgagggcgtggctgcactttccggaggtcagcagttggctttagagcctcccgacttagctcgcaaaaaacgcaggagcgataagaactaa

SEQ ID NO: 3330 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRADKHREGVAALSGGQQLALEPPDLARKKRRSDKN

SEQ ID NO: 3331 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcggccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacgtgtgattcttcgcaattatgaaggtgttatcacaacctatacggagccggaggactatcatggggagtgcgattgtgaggactgccgagccggcaagcatcgtgagggcgtggctgcactttccggaggtcagcagttggctttagagcctcccgacttagctcgcaaaaaacgcaggagcgataagaactaa

SEQ ID NO: 3332 - protein, 416 aa, Artificial Sequence
  Description of Artificial Sequence: Synthetic Construct
MAESRRKHYFPDVTDEQWYDWHWQVINRIKTLGQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRRVILRNYEGVITTYTEPEDYHGECDCEDCRAGKHREGVAALSGGQQLALEPPDLARKKRRSDKN

SEQ ID NO: 3333 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagcaaaagaatcgcccaaagtactccgaatggctatcacaccttattatttgagtttgatagaccccgagaatcctaattgtccgattcgtaaacaagccattcctactcgtcgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacgtgtgattcttcgcaattatgaaggtgttatcacgacctatacggagccggaggactatcatggggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3334 - protein, 416 aa, Artificial Sequence
  Description of Artificial Sequence: Synthetic Construct
MAESRRKHYFPDVTDEQWYDWHWQVINRIKTLDQLEKYVTLTAEEEEGAKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRRVILRNYEGVITTYTEPEDYHGECDCEDCRVDKHREGVAALSGGQQLALEPPDLARKERRSDKN

SEQ ID NO: 3335 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtactgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacgtgtggttcttcgcaattatgaaggtgttatcacaacctatacggagccggaggactatcatggggagtgcgattgtgaggactgccgagtcggcaagcatcgtgagggcgtggctgcactttccggaggtcagcagttggctttagagcctcccgacttagctcgcaaagaacgcaggagcgataagaactaa

SEQ ID NO: 3336 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRRVVLRNYEGVITTYTEPEDYHGECDCEDCRVGKHREGVAALSGGQQLALEPPDLARKERRSDKN

SEQ ID NO: 3337 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgccgggaactggtacgtgctcctgaagatatggtagacccacttagtgaagatgaagattcgcccgtacccggactgactcatcgttatccggatcgtgtattgctccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3338 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTRRELVRAPEDMVDPLSEDEDSPVPGLTHRYPDRVLLLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 3339 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaagtttgcgcggacacacctcgggctatgcagttcctacctttgtggtacatgctccggggggtggtggtaagatacctgtagcgccgaactatgttgtatctcagtccccacgacgtgtggttcttcgcaattatgaaggtgttatcacaacctatacggagccggaggactatcatggggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3340 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIESLRGHTSGYAVPTFVVHAPGGGGKIPVAPNYVVSQSPRRVVLRNYEGVITTYTEPEDYHGECDCEDCRVDKHREGVAALSGGQQLALEPPDLARKKRRSDKN

SEQ ID NO: 3341 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcggccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgccgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttaccacaacctatacggagccggaggactatcatgaggagtgcgattgtgaggactgccgagtcggcaagcatcgtgagggcgtggctgcactttccggaggtcagcagttggctttagagcctcccgacttagctcgcaaagaacgcaggagcgataggaactaa

SEQ ID NO: 3342 - protein, 416 aa, Artificial Sequence
  Description of Artificial Sequence: Synthetic Construct
MAESRRKHYFPDVTDEQWYDWHWQVINRIKTLGQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVTTTYTEPEDYHEECDCEDCRVGKHREGVAALSGGQQLALEPPDLARKERRSDRN

SEQ ID NO: 3343 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgtcgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacgtgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3344 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRRVVLRNYEGVITTYTEPEDYHEECDCEDCRVDKHREGVAALSGGQQLALEPPDLARKERRSDKN

SEQ ID NO: 3345 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgccgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3346 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKKRRSDKN

SEQ ID NO: 3347 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgccgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgagctatgttgtatctcagtccccacgacatgtggttcttcgcaattatgaaggtgttaccacaacctatacggagccggaggactatcatggggagtgcgattgtgaggactgccgagtcggcaagcatcgtgagggcgtggctgcactttccggaggtcagcagttggctttagagcctcccgacttagctcgcaaaaaacgcaggagcgataagaactaa

SEQ ID NO: 3348 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPSYVVSQSPRHVVLRNYEGVTTTYTEPEDYHGECDCEDCRVGKHREGVAALSGGQQLALEPPDLARKKRRSDKN

SEQ ID NO: 3349 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcggccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaaccatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3350 - protein, 416 aa, Artificial Sequence
  Description of Artificial Sequence: Synthetic Construct
MAESRRKHYFPDVTDEQWYDWHWQVINRIKTLGQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNHVVSQSPRHVVLRNYEGVITTYTEPEDYHEECDCEDCRVDKHREGVAALSGGQQLALEPPDLARKKRRSDKN

SEQ ID NO: 3351 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcggccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgccgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttaccacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3352 - protein, 416 aa, Artificial Sequence
  Description of Artificial Sequence: Synthetic Construct
MAESRRKHYFPDVTDEQWYDWHWQVINRIKTLGQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVTTTYTEPEDYHEECDCEDCRVDKHREGVAALSGGQQLALEPPDLARKERRSDKN

SEQ ID NO: 3353 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacgtgtggttcttcgcaattatgaaggtgttatcacaacctatacggagccggaggactatcatggggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3354 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRRVVLRNYEGVITTYTEPEDYHGECDCEDCRVDKHREGVAALSGGQQLALEPPDLARKERRSDKN

SEQ ID NO: 3355 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcggccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtgattcttcgcaattatgaaggtgttatcacaacctatacggagccggaggactatcatgaggagtgcgattgtgaggactgccgagtcgacaagcatcgtgagggcgtggctgcactttccgggggtcagcagttggctttagagcctcccgacttagctcgcaaagaacgcaggagcgataagaactaa

SEQ ID NO: 3356 - protein, 416 aa, Artificial Sequence
  Description of Artificial Sequence: Synthetic Construct
MAESRRKHYFPDVTDEQWYDWHWQVINRIKTLGQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVILRNYEGVITTYTEPEDYHEECDCEDCRVDKHREGVAALSGGQQLALEPPDLARKERRSDKN

SEQ ID NO: 3357 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcggccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacgtgtggttcttcgcaattatgaaggtgttatcacaacctatacggagccggaggactatcatggggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3358 - protein, 416 aa, Artificial Sequence
  Description of Artificial Sequence: Synthetic Construct
MAESRRKHYFPDVTDEQWYDWHWQVINRIKTLGQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRRVVLRNYEGVITTYTEPEDYHGECDCEDCRVDKHREGVAALSGGQQLALEPPDLARKKRRSDKN

SEQ ID NO: 3359 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3360 - protein, 416 aa, Artificial Sequence; identical to SEQ ID NO: 3260
  Description of Artificial Sequence: Synthetic Construct

SEQ ID NO: 3361 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcggccagctggagaagtacgttacactcaccgctgaagaagaagagggagtaaaaggatcgcccaaagtactccgaatggctatcacaccttattatttgagtttgatagaccccgagaatcctaattgtccgattcgtaaacaagccattcctactcgacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagccggcaagcatcgtgagggcgtggctgcactttccggaggtcagcagttggctttagagcctcccgacttagctcgcaaagaacgcaggagcgataagaactaa

SEQ ID NO: 3362 - protein, 416 aa, Artificial Sequence
  Description of Artificial Sequence: Synthetic Construct
MAESRRKHYFPDVTDEQWYDWHWQVINRIKTLGQLEKYVTLTAEEEEGVKGSPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRAGKHREGVAALSGGQQLALEPPDLARKERRSDKN

SEQ ID NO: 3363 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcggccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgccgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttaccacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3364 - protein, 416 aa, Artificial Sequence; identical to SEQ ID NO: 3352
  Description of Artificial Sequence: Synthetic Construct

SEQ ID NO: 3365 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcggccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgtcgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacgtgtgattcttcgcaattatgaaggtgttaccacaacctatacggagccggaggactatcatgaggagtgcgattgtgaggactgccgagccgacaagcatcgtgagggcgtggctgcactttccggaggtcagcagttggctttagagcctcccgacttagctcgcaaagaacgcaggagcgataagaactaa

SEQ ID NO: 3366 - protein, 416 aa, Artificial Sequence
  Description of Artificial Sequence: Synthetic Construct
MAESRRKHYFPDVTDEQWYDWHWQVINRIKTLGQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRRVILRNYEGVTTTYTEPEDYHEECDCEDCRADKHREGVAALSGGQQLALEPPDLARKERRSDKN

SEQ ID NO: 3367 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacgggaactggtacgtgctcctgaagatatggtagacccacttagtgaagatgaagattcgcccgtacccggactgactcatcgttatccggatcgcgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatggggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3368 - protein, 416 aa, Artificial Sequence; identical to SEQ ID NO: 3266
  Description of Artificial Sequence: Synthetic Construct

SEQ ID NO: 3369 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgccgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtgattcttcgcaattatgaaggtgttatcacaacctatacggagccggaggactatcatggggagtgcgattgtgaggactgccgagtcggcaagcatcgtgagggcgtggctgcactttccggaggtcagcagttggctttagagcctcccgacttagctcgcaaagaacgcaggagcgataagaactaa

SEQ ID NO: 3370 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVILRNYEGVITTYTEPEDYHGECDCEDCRVGKHREGVAALSGGQQLALEPPDLARKERRSDKN

SEQ ID NO: 3371 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatggggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3372 - protein, 416 aa, Artificial Sequence; identical to SEQ ID NO: 3270
  Description of Artificial Sequence: Synthetic Construct

SEQ ID NO: 3373 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaaaacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3374 - protein, 416 aa, Artificial Sequence; identical to SEQ ID NO: 3274
  Description of Artificial Sequence: Synthetic Construct

SEQ ID NO: 3375 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgtcgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattggagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3376 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILERLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKKRRSDKN

SEQ ID NO: 3377 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccagagtactccgaatggctatcacaccttattatttgagtttgatagaccccgagaatcctaattgtccgattcgtaaacaagccattcctactcgtcgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgtccgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtgattcttcgcaattatgaaggtgctatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3378 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPRVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVILRNYEGAITTYTEPEDYHEECDCEDCRVDKHREGVAALSGGQQLALEPPDLARKERRSDKN

SEQ ID NO: 3379 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3380 - protein, 416 aa, Artificial Sequence; identical to SEQ ID NO: 3260
  Description of Artificial Sequence: Synthetic Construct

SEQ ID NO: 3381 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtgattcttcgcaattatgaaggtgttatcacaacctatacggagccggaggactatcatgaggagtgcgattgtgaggactgccgagtcggcaagcatcgtgagggcgtggctgcactttccggaggtcagcagttggctttagagcctcccgacttagctcgcaaaaaacgcaggagcgataagaactaa

SEQ ID NO: 3382 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVILRNYEGVITTYTEPEDYHEECDCEDCRVGKHREGVAALSGGQQLALEPPDLARKKRRSDKN

SEQ ID NO: 3383 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacgggaactggtacgtgctcctgaagatatggtagacccacttagtgaagatgaagattcgcccgtacccggactgactcatcgttatccggatcgtgtattgttccttatcacggacaaatgttcgatgtactgccgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatggggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3384 - protein, 416 aa, Artificial Sequence; identical to SEQ ID NO: 3266
  Description of Artificial Sequence: Synthetic Construct

SEQ ID NO: 3385 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcggccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgtcgggaactggtacgtgctcctgaagatatggtagaccctcttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacgtgtgattcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3386 - protein, 416 aa, Artificial Sequence
  Description of Artificial Sequence: Synthetic Construct
MAESRRKYYFPDVTDEQWYDWHWQVINRIKTLGQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRRVILRNYEGVITTYTEPEDYHEECDCEDCRVDKHREGVAALSGGQQLALEPPDLARKKRRSDKN

SEQ ID NO: 3387 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgccgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccctctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggcatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatggggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3388 - protein, 416 aa, Artificial Sequence; identical to SEQ ID NO: 3266
  Description of Artificial Sequence: Synthetic Construct

SEQ ID NO: 3389 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcggccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtgattcttcgcaattatgaaggtgttatcacaacctatacggagccggaggactatcatggggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3390 - protein, 416 aa, Artificial Sequence
  Description of Artificial Sequence: Synthetic Construct
MAESRRKHYFPDVTDEQWYDWHWQVINRIKTLGQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVILRNYEGVITTYTEPEDYHGECDCEDCRVDKHREGVAALSGGQQLALEPPDLARKKRRSDKN

SEQ ID NO: 3391 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatggggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3392 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHGECDCEDCRVDKHREGVAALSGGQQLALEPPDLARKKRRSDKN

SEQ ID NO: 3393 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgtcgggaactggtacgtgctcctgaagatatggtagacccacttagtgaagatgaagattcgcccgtacccggactgactcatcgttatccggatcgtgtattgttccttatcacggacaaatgttcgatgtaccgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacgtgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3394 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYRRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRRVVLRNYEGVITTYTEPEDYHEECDCEDCRVDKHREGVAALSGGQQLALEPPDLARKERRSDKN

SEQ ID NO: 3395 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgggcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatggggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3396 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSGRIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHGECDCEDCRVDKHREGVAALSGGQQLALEPPDLARKKRRSDKN

SEQ ID NO: 3397 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatgtatgctcgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactgtgttgtatctcagtccccacgacatgtggttcttcgcaatcatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3398 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYMYARDLSLGIGHFRTPVSKGIEIIENLRGHTSGYAVPTFVVHAPGGGGKIPVAPNCVVSQSPRHVVLRNHEGVITTYTEPEDYHEECDCEDCRVDKHREGVAALSGGQQLALEPPDLARKKRRSDKN

SEQ ID NO: 3399 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgtcgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttaccacaacctatacggagccggaggactatcatggggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3400 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVTTTYTEPEDYHGECDCEDCRVDKHREGVAALSGGQQLALEPPDLARKERRSDKN

SEQ ID NO: 3401 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcagtcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttaccacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3402 - protein, 416 aa, Artificial Sequence
  Description of Artificial Sequence: Synthetic Construct
MAESRRKHYFPDVTDEQWYDWHWQVISRIKTLDQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVTTTYTEPEDYHEECDCEDCRVDKHREGVAALSGGQQLALEPPDLARKKRRSDKN

SEQ ID NO: 3403 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgtcgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatacagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaacggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggtttttcgcaattatgaaggtgttaccacaacctatacggagccggaggactatcatggggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3404 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYTANTPTVRDVLLSGGDALLVSDERLEYILKRLREVPHVEIVRIGSRAPVVLPQRITPQLVDMLKKYHPVWLNTHFNHPNEVTEEAVEACERTANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVFRNYEGVTTTYTEPEDYHGECDCEDCRVDKHREGVAALSGGQQLALEPPDLARKKRRSDKN

SEQ ID NO: 3405 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcggccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgccgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtaaatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttaccacaacctatacggagccggaggactatcatggggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3406 - protein, 156 aa, Artificial Sequence
  Description of Artificial Sequence: Synthetic Construct
MAESRRKHYFPDVTDEQWYDWHWQVINRIKTLGQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIE

SEQ ID NO: 3407 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcggccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatggggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3408 - protein, 416 aa, Artificial Sequence
  Description of Artificial Sequence: Synthetic Construct
MAESRRKYYFPDVTDEQWYDWHWQVINRIKTLGQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHGECDCEDCRVDKHREGVAALSGGQQLALEPPDLARKERRSDKN

SEQ ID NO: 3409 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcggccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgccgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcgcgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatggggagtgcgattgtgaggactgccgagtcgacaagcatcgtgagggcgtggctgcactttccggaggtcggcagttggctttagagcctcccgacttagctcgcaaagaacgcaggagcgataagaactaa

SEQ ID NO: 3410 - protein, 416 aa, Artificial Sequence
  Description of Artificial Sequence: Synthetic Construct
MAESRRKHYFPDVTDEQWYDWHWQVINRIKTLGQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRAPVSKGIEIIENLRGHTSGYAVPTFVVHAPGGGGKIPVAPNYVVSQSPRHVVLRNYEGVITTYTEPEDYHGECDCEDCRVDKHREGVAALSGGRQLALEPPDLARKERRSDKN

SEQ ID NO: 3411 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcggccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacgtgtgattcttcgcaattatgaaggtgttatcacaacctatacggagccggaggactatcatgaggagtgcgattgtgaggactgccgagccgacaagcatcgtgagggcgtggctgcactttccggaggtcagcagttggctttagagcctcccgacttagctcgcaaagaacgcaggagcgataagaactaa

SEQ ID NO: 3412 - protein, 416 aa, Artificial Sequence
  Description of Artificial Sequence: Synthetic Construct
MAESRRKHYFPDVTDEQWYDWHWQVINRIKTLGQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRRVILRNYEGVITTYTEPEDYHEECDCEDCRADKHREGVAALSGGQQLALEPPDLARKERRSDKN

SEQ ID NO: 3413 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcggccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaacacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtacctcagtccccacgacatgtgattcttcgcaattatgaaggtgttatcacaacctatacggagccggaggactatcatgaggagtgcgattgtgaggactgccgagtcggcaagcatcgtgagggcgtggctgcactttccggaggtcagcagttggctttagagcctcccgacttagctcgcaaagaacgcaggagcgataagaactaa

SEQ ID NO: 3414 - protein, 416 aa, Artificial Sequence
  Description of Artificial Sequence: Synthetic Construct
MAESRRKHYFPDVTDEQWYDWHWQVINRIKTLGQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVPQSPRHVILRNYEGVITTYTEPEDYHEECDCEDCRVGKHREGVAALSGGQQLALEPPDLARKERRSDKN

SEQ ID NO: 3415 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctgtgcagttcctacctttgtggtacatgctccggggggtggtggtgagatacctgtagcgccgaactatgttgtatctcagtccccacgacatgtggttcttcgcaattatgaaggtgttaccacaacctatacggagccggaggactatcatgaggagtgcgattgtgaggactgccgagtcggcaagcatcgtgagggcgtggctgcactttccggaggtcagcagttggctttagagcctcccgacttagctcgcaaaaaacgcaggagcgataagaactaa

SEQ ID NO: 3416 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGCAVPTFVVHAPGGGGEIPVAPNYVVSQSPRHVVLRNYEGVTTTYTEPEDYHEECDCEDCRVGKHREGVAALSGGQQLALEPPDLARKKRRSDKN

SEQ ID NO: 3417 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacgctcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttaccacaacctatacggagccggaggactatcatgaggagtgcgattgtgaggactgccgagccggcaagcatcgtgagggcgtggctgcactttccggaggtcagcagttggctttagagcctcccgacttagctcgcaaagaacgcaggagcgataagaactaa

SEQ ID NO: 3418 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNAHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVTTTYTEPEDYHEECDCEDCRAGKHREGVAALSGGQQLALEPPDLARKERRSDKN

SEQ ID NO: 3419 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcggccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatggggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3420 - protein, 416 aa, Artificial Sequence
  Description of Artificial Sequence: Synthetic Construct
MAESRRKHYFPDVTDEQWYDWHWQVINRIKTLGQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHGECDCEDCRVDKHREGVAALSGGQQLALEPPDLARKKRRSDKN

SEQ ID NO: 3421 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgtcgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtgattcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3422 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVILRNYEGVITTYTEPEDYHEECDCEDCRVDKHREGVAALSGGQQLALEPPDLARKERRSDKN

SEQ ID NO: 3423 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcggccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttctgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtagccaaacggttttattgcgtggaatcaatgatagtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatggggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3424 - protein, 416 aa, Artificial Sequence
  Description of Artificial Sequence: Synthetic Construct
MAESRRKHYFPDVTDEQWYDWHWQVINRIKTLGQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGSQTVLLRGINDSTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHGECDCEDCRVDKHREGVAALSGGQQLALEPPDLARKKRRSDKN

SEQ ID NO: 3425 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcggccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgccgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacgcacctcgggctatgcagttcctacctttgtggtacatgctccggggggaggtggtaagatacctgtagcgccgaactatgttgtatctcagtccccacgacatctggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3426 - protein, 416 aa, Artificial Sequence
  Description of Artificial Sequence: Synthetic Construct
MAESRRKHYFPDVTDEQWYDWHWQVINRIKTLGQLEKYVTLTAEEEEGVKESPKVLRMAITPYYLSLIDPENPNCPIRKQAIPTRRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGRTSGYAVPTFVVHAPGGGGKIPVAPNYVVSQSPRHLVLRNYEGVITTYTEPEDYHEECDCEDCRVDKHREGVAALSGGQQLALEPPDLARKERRSDKN

SEQ ID NO: 3427 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcggccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcgtcgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagccggcaagcatcgtgagggcgtggctgcactttccggaggtcagcagttggctttagagcctcccgacttagctcgcaaagaacgcaggagcgataagaactaa

SEQ ID NO: 3428 - protein, 416 aa, Artificial Sequence; identical to SEQ ID NO: 3284
  Description of Artificial Sequence: Synthetic Construct

SEQ ID NO: 3429 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcggagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3430 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLRGVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKKRRSDKN

SEQ ID NO: 3431 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaggacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcggagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtggaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctacactttccggaggtcagcagttggctttagagcctcccgacttagctcgcaaaaaacgcaggagcgataagaactaa

SEQ ID NO: 3432 - protein, 416 aa, Artificial Sequence
  Description of Artificial Sequence: Synthetic Construct
MAESRRKYYFPDVTDEQWYDWHWQVINRIRTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLRGVPHVEIVRIGSRAPVVLPQRITPQLVDMLKKYHPVWLNTHFNHPNEVTEEAVEACGRMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVATLSGGQQLALEPPDLARKKRRSDKN

SEQ ID NO: 3433 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaggacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3434 - protein, 416 aa, Artificial Sequence
  Description of Artificial Sequence: Synthetic Construct
MAESRRKYYFPDVTDEQWYDWHWQVINRIRTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKKRRSDKN

SEQ ID NO: 3435 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaggaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcgattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctacactttccggaggtcagcagttggctttagagcctcccgacttagctcgcaaaaaacgcaggagcgataagaactaa

SEQ ID NO: 3436 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPRLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVATLSGGQQLALEPPDLARKKRRSDKN

SEQ ID NO: 3437 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaggacgctcgaccagctggagaagtacgttacactcaccgctgaagaagaagggggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcagggcagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcggagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtggaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctacactttccggaggtcagcagttggctttagagcctcccgacttagctcgcaaaaaacgcaggagcgataagaactaa

SEQ ID NO: 3438 - protein, 416 aa, Artificial Sequence
  Description of Artificial Sequence: Synthetic Construct
MAESRRKYYFPDVTDEQWYDWHWQVINRIRTLDQLEKYVTLTAEEEGGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLRGVPHVEIVRIGSRAPVVLPQRITPQLVDMLKKYHPVWLNTHFNHPNEVTEEAVEACGRMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVATLSGGQQLALEPPDLARKKRRSDKN

SEQ ID NO: 3439 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaggacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcggagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtggaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3440 - protein, 416 aa, Artificial Sequence
  Description of Artificial Sequence: Synthetic Construct
MAESRRKYYFPDVTDEQWYDWHWQVINRIRTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLRGVPHVEIVRIGSRAPVVLPQRITPQLVDMLKKYHPVWLNTHFNHPNEVTEEAVEACGRMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKKRRSDKN

SEQ ID NO: 3441 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaggacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcggagtacctcatgtggagattgttcgtataggaagccgtgcgccggtagtcctccctcagcgtataacgcctcgattggtggatatgctcaaaaaatatcatccggtgtggctgaacactcacttcaaccacccgaatgaagttaccgaagaagcagtggaggcttgtggaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgaactttccggaggtcagcagttggctttagagcctcccgacttagctcgcaaaaaacgcaggagcgataagaactaa

SEQ ID NO: 3442 - protein, 416 aa, Artificial Sequence
  Description of Artificial Sequence: Synthetic Construct
MAESRRKYYFPDVTDEQWYDWHWQVINRIRTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLRGVPHVEIVRIGSRAPVVLPQRITPRLVDMLKKYHPVWLNTHFNHPNEVTEEAVEACGRMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAELSGGQQLALEPPDLARKKRRSDKN

SEQ ID NO: 3443 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcggagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgaactttccggaggtcagcagttggctttagagcctcccgacttagctcgcaaaaaacgcaggagcgataagaactaa

SEQ ID NO: 3444 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLRGVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAELSGGQQLALEPPDLARKKRRSDKN

SEQ ID NO: 3445 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacggtccgcgatgttttgctatcgggaggcgatgccctccttgtcagcgacgaacgcttggaatacatattgaagcgtctgcgcggagtacctcatgtggagattgttcgtataggaagccgtgcgccggtagtcctccctcagcgtataacgcctcgattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgaactttccggaggtcagcagttggctttagagcctcccgacttagctcgcaaaaaacgcaggagcgataagaactaa

SEQ ID NO: 3446 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLRGVPHVEIVRIGSRAPVVLPQRITPRLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAELSGGQQLALEPPDLARKKRRSDKN

SEQ ID NO: 3447 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaggacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtggaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgaactttccggaggtcagcagttggctttagagcctcccgacttagctcgcaaaaaacgcaggagcgataagaactaa

SEQ ID NO: 3448 - protein, 416 aa, Artificial Sequence
  Description of Artificial Sequence: Synthetic Construct
MAESRRKYYFPDVTDEQWYDWHWQVINRIRTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACGRMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAELSGGQQLALEPPDLARKKRRSDKN

SEQ ID NO: 3449 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaggacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaagtttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3450 - protein, 416 aa, Artificial Sequence
  Description of Artificial Sequence: Synthetic Construct
MAESRRKYYFPDVTDEQWYDWHWQVINRIRTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIESLRGHTSGYAVPTFVVHAPGGGGKIPVAPNYVVSQSPRHVVLRNYEGVITTYTEPEDYHEECDCEDCRVDKHREGVAALSGGQQLALEPPDLARKKRRSDKN

SEQ ID NO: 3451 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaggacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcggagtacctcatgtggagattgttcgtataggaagccgtgcgccggtagtcctccctcagcgtataacgcctcgattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgaactttccggaggtcagcagttggctctagagcctcccgacttagctcgcaaaaaacgcaggagcgataagaactaa

SEQ ID NO: 3452 - protein, 416 aa, Artificial Sequence
  Description of Artificial Sequence: Synthetic Construct
MAESRRKYYFPDVTDEQWYDWHWQVINRIRTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLRGVPHVEIVRIGSRAPVVLPQRITPRLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAELSGGQQLALEPPDLARKKRRSDKN

SEQ ID NO: 3453 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaggaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcggagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtggaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgaactttccggaggtcagcagttggctttagagcctcccgacttagctcgcaaaaaacgcaggagcgataagaactaa

SEQ ID NO: 3454 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLRGVPHVEIVRIGSRAPVVLPQRITPQLVDMLKKYHPVWLNTHFNHPNEVTEEAVEACGRMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAELSGGQQLALEPPDLARKKRRSDKN

SEQ ID NO: 3455 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgaactttccggaggtcagcagttggctttagagcctcccgacttagctcgcaaaaaacgcaggagcgataagaactaa

SEQ ID NO: 3456 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAELSGGQQLALEPPDLARKKRRSDKN

SEQ ID NO: 3457 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaggacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccagaggactatcatgaggagtgcgattgtgaggactgccgagtcgacaagcatcgtgagggcgtggctgaactttccggaggtcagcagttggctttagagcctcccgacttagctcgcaaaaaacgcaggagcgataagaactaa

SEQ ID NO: 3458 - protein, 416 aa, Artificial Sequence
  Description of Artificial Sequence: Synthetic Construct
MAESRRKYYFPDVTDEQWYDWHWQVINRIRTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAELSGGQQLALEPPDLARKKRRSDKN

SEQ ID NO: 3459 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaggacgctcgaccagctggagaagtacgttacactcaccgctggggaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtggaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgaactttccggaggtcagcagttggctttagagcctcccgacttagctcgcaaaaaacgcaggagcgataagaactaa

SEQ ID NO: 3460 - protein, 416 aa, Artificial Sequence
  Description of Artificial Sequence: Synthetic Construct
MAESRRKYYFPDVTDEQWYDWHWQVINRIRTLDQLEKYVTLTAGEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACGRMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAELSGGQQLALEPPDLARKKRRSDKN

SEQ ID NO: 3461 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaggacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgaactttccggaggtcagcagttggctttagagcctcccgacttagctcgcaaaaaacgcaggagcgataagaactaa

SEQ ID NO: 3462 - protein, 416 aa, Artificial Sequence; identical to SEQ ID NO: 3458
  Description of Artificial Sequence: Synthetic Construct

SEQ ID NO: 3463 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcggagtacctcatgtggagattgttcgtataggaagccgtgcgccagtagtcctccctcagcgtataacgcctcgattggtggatatgctcaaaaaatatcatccggtgtggctgaacactcacttcaaccacccgaatgaagttaccgaagaagcagtggaggcttgtggaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3464 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLRGVPHVEIVRIGSRAPVVLPQRITPRLVDMLKKYHPVWLNTHFNHPNEVTEEAVEACGRMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKKRRSDKN

SEQ ID NO: 3465 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcggagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtggaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgaactttccggaggtcagcagttggctttagagcctcccgacttagctcgcaaaaaacgcaggagcgataagaactaa

SEQ ID NO: 3466 - protein, 416 aa, Artificial Sequence; identical to SEQ ID NO: 3454
  Description of Artificial Sequence: Synthetic Construct

SEQ ID NO: 3467 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaggacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtggaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctacactttccggaggtcagcagttggctttagagcctcccgacttagctcgcaaaaaacgcaggagcgataagaactaa

SEQ ID NO: 3468 - protein, 416 aa, Artificial Sequence
  Description of Artificial Sequence: Synthetic Construct
MAESRRKYYFPDVTDEQWYDWHWQVINRIRTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACGRMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVATLSGGQQLALEPPDLARKKRRSDKN

SEQ ID NO: 3469 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaggacgctcgaccagctggagaagtacgttacactcaccgctgaagaagaagagggagtaaaagaatcgcccaaagtactccgaatggctatcacaccttattatttgagtttggtagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3470 - protein, 416 aa, Artificial Sequence
  Description of Artificial Sequence: Synthetic Construct
MAESRRKYYFPDVTDEQWYDWHWQVINRIRTLDQLEKYVTLTAEEEEGVKESPKVLRMAITPYYLSLVDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKKRRSDKN

SEQ ID NO: 3471 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcggagtacctcatgtggagattgttcgtataggaagccgtgcgccggtagtcctccctcagcgtataacgcctcgattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3472 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLRGVPHVEIVRIGSRAPVVLPQRITPRLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKKRRSDKN

SEQ ID NO: 3473 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttccccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcgattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagactggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3474 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPRLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKKRRSDKN

SEQ ID NO: 3475 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctggagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcggagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtggaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3476 - protein, 416 aa, Artificial Sequence
  Description of Artificial Sequence: Synthetic Construct
MAESRRKYYFPDVTDEQWYDWHWQVINRIKTLDQLEKYVTLTAGEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLRGVPHVEIVRIGSRAPVVLPQRITPQLVDMLKKYHPVWLNTHFNHPNEVTEEAVEACGRMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKKRRSDKN

SEQ ID NO: 3477 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaggacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcgattggtggatatgctcaaaaaatatcatccggtgtggctgaacactcacttcaaccacccgaatgaagttaccgaagaagcagtggaggcttgtggaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3478 - protein, 416 aa, Artificial Sequence
  Description of Artificial Sequence: Synthetic Construct
MAESRRKYYFPDVTDEQWYDWHWQVINRIRTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPRLVDMLKKYHPVWLNTHFNHPNEVTEEAVEACGRMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKKRRSDKN

SEQ ID NO: 3479 - DNA, 1251 bp, Artificial Sequence
  Description of Artificial Sequence: Synthetic Construct
atggcagaaagtcgtagaaagtattacttccctgatgtcaccgatgagcaatggtacgactggcattggcaggtcatcaatcgaattaggacgctcgaccagctggagaagtacgttacactcaccgctggggaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcgattggtggatatgctcaaaaaatatcatccggtgtggctgaacactcacttcaaccacccgaatgaagttaccgaagaagcagtggaggcttgtggaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgaactttccggaggtcggcagttggctttagagcctcccgacttagctcgcaaaaaacgcaggagcgataagaactaa

SEQ ID NO: 3480 - protein, 416 aa, Artificial Sequence
  Description of Artificial Sequence: Synthetic Construct
MAESRRKYYFPDVTDEQWYDWHWQVINRIRTLDQLEKYVTLTAGEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPRLVDMLKKYHPVWLNTHFNHPNEVTEEAVEACGRMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAELSGGRQLALEPPDLARKKRRSDKN

SEQ ID NO: 3481 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcggagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtggaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctacactttccggaggtcagcagttggctttagagcctcccgacttagctcgcaaaaaacgcaggagcgataagaactaa

SEQ ID NO: 3482 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLRGVPHVEIVRIGSRAPVVLPQRITPQLVDMLKKYHPVWLNTHFNHPNEVTEEAVEACGRMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVATLSGGQQLALEPPDLARKKRRSDKN

SEQ ID NO: 3483 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaggacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcgattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3484 - protein, 416 aa, Artificial Sequence
  Description of Artificial Sequence: Synthetic Construct
MAESRRKYYFPDVTDEQWYDWHWQVINRIRTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPRLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKKRRSDKN

SEQ ID NO: 3485 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcggagtacctcatgtggagattgttcgtataggaagccgtgcgccggtagtcctccctcagcgtataacgcctcgattggtggatatgctcaaaaaatatcatccggtgtggctgaacactcacttcaaccacccgaatgaagttaccgaagaagcagtggaggcttgtggaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgaactttccggaggtcagcagttggctttagagcctcccgacttagctcgcaaaaaacgcaggagcgataagaactaa

SEQ ID NO: 3486 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLRGVPHVEIVRIGSRAPVVLPQRITPRLVDMLKKYHPVWLNTHFNHPNEVTEEAVEACGRMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAELSGGQQLALEPPDLARKKRRSDKN

SEQ ID NO: 3487 - DNA, 1251 bp, Artificial Sequence
  Description of Artificial Sequence: Synthetic Construct
atggcagaaagtcgtagaaagtattacttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgctacgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcggagtacctcatgtggagattgttcgtataggaagccgtgcgccggtagtcctccctcagcgtataacgcctcgattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgaactttccggaggtcagcagttggctttagagcctcccgacttagctcgcaaaaaacgcaggagcgataagaactaa

SEQ ID NO: 3488 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRYAGQRDASSPSERIDRCIEYIANTPTVRDVLLSGGDALLVSDERLEYILKRLRGVPHVEIVRIGSRAPVVLPQRITPRLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAELSGGQQLALEPPDLARKKRRSDKN

SEQ ID NO: 3489 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaggacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcggagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtggaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctaccttcgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctacactttccggaggtcagcagttggctttagagcctcccgacttagctcgcaaaaaacgcaggagcgataagaactaa

SEQ ID NO: 3490 - protein, 416 aa, Artificial Sequence; identical to SEQ ID NO: 3432
  Description of Artificial Sequence: Synthetic Construct

SEQ ID NO: 3491 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaggagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgtattgagtatatagccaatacaccgacagtccgcgatgttttgctatcgggaggcgatgccctccttgtcagcgacgaacgcttggaatacatattgaagcgtctgcgcggagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctacactttccggaggtcagcagttggctttagagcctcccgacttagctcgcaaaaaacgcaggagcgataagaactaa

SEQ ID NO: 3492 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLRGVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVATLSGGQQLALEPPDLARKKRRSDKN

SEQ ID NO: 3493 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcggagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctacactttccggaggtcagcagttggctttagagcctcccgacttagctcgcaaaaaacgcaggagcgataagaactaa

SEQ ID NO: 3494 - protein, 416 aa, Artificial Sequence; identical to SEQ ID NO: 3492
  Description of Artificial Sequence: Synthetic Construct

SEQ ID NO: 3495 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcaacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggtctgccgagtcgacaagcatcgtgagggcgtggctgcactttccggaggtcagcagttggctttagagcctcccgacttagctcgcaaaaaacgcaggagcgataagaactaa

SEQ ID NO: 3496 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSNERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEVCRVDKHREGVAALSGGQQLALEPPDLARKKRRSDKN

SEQ ID NO: 3497 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgcattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgaactttccggaggtcagcagttggctttagagcctcccgacttagctcgcaaaaaacgcaggagcgataagaactaa

SEQ ID NO: 3498 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRALFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAELSGGQQLALEPPDLARKKRRSDKN

SEQ ID NO: 3499 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcggagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctctagagcctcccgacttagctcgcaaaaaacgcaggagcgataagaactaa

SEQ ID NO: 3500 - protein, 416 aa, Artificial Sequence; identical to SEQ ID NO: 3430
  Description of Artificial Sequence: Synthetic Construct

SEQ ID NO: 3501 - DNA, 1251 bp, Artificial Sequence
  Description of Artificial Sequence: Synthetic Construct
atggcagaaagtcgtagaaagttttatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcggagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatcccagtccccacgacatgtggttcttcgcaattatgaaggtgttatcacaacctatacggagccggaggactatcatgaggagtgcgattgtgaggactgccgagtcgacaagcatcgtgagggcgtggctacactttccggaggtcagcagttggctttagagcctcccgacttagctcgcaaaaaacgcaggagcgataagaactaa

SEQ ID NO: 3502 - protein, 416 aa, Artificial Sequence
  Description of Artificial Sequence: Synthetic Construct
MAESRRKFYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLRGVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVATLSGGQQLALEPPDLARKKRRSDKN

SEQ ID NO: 3503 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcggagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggagatcagcagttggctttagagcctcccgacttagctcgcaaaaaacgcaggagcgataagaactaa

SEQ ID NO: 3504 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLRGVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGDQQLALEPPDLARKKRRSDKN

SEQ ID NO: 3505 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcggagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtggaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3506 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLRGVPHVEIVRIGSRAPVVLPQRITPQLVDMLKKYHPVWLNTHFNHPNEVTEEAVEACGRMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKKRRSDKN

SEQ ID NO: 3507 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaggacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcggagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtggaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctacactttccggaggtcagcagttggctttagagcctcccgacttagctcgcagaaaacgcaggagcgataagaactaa

SEQ ID NO: 3508 - protein, 416 aa, Artificial Sequence
  Description of Artificial Sequence: Synthetic Construct
MAESRRKYYFPDVTDEQWYDWHWQVINRIRTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLRGVPHVEIVRIGSRAPVVLPQRITPQLVDMLKKYHPVWLNTHFNHPNEVTEEAVEACGRMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVATLSGGQQLALEPPDLARRKRRSDKN

SEQ ID NO: 3509 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaggacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggcagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcggagtacctcatgtggagattgttcgtataggaagccgtgcgccggtagtcctccctcagcgtataacgcctcgattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3510 - protein, 416 aa, Artificial Sequence
  Description of Artificial Sequence: Synthetic Construct
MAESRRKYYFPDVTDEQWYDWHWQVINRIRTLDQLEKYVTLTAEEEEGVKESPKVLRMAITPYYLSLIDPENPNCPIRKQAIPTKRELVRAPEDMADPLSEDEDSPVPGLTHRYPDRVLFLITDKCSMYCRHCTRRRFAGQRDASSPSERIDRCIEYIANTPTVRDVLLSGGDALLVSDERLEYILKRLRGVPHVEIVRIGSRAPVVLPQRITPRLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKKRRSDKN

SEQ ID NO: 3511 - DNA, 1251 bp, Artificial Sequence
  Description of Artificial Sequence: Synthetic Construct
atggcagaaagtcgtagaaagtattatttccctgatgtccccgatgagcaatggtacgactggcattggcaggtcatcaatcgaattaggacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgaactttccggaggtcagcagttggctttagagcctcccgacttagctcgcaaaaaacgcaggagcgataagaactaa

SEQ ID NO: 3512 - protein, 416 aa, Artificial Sequence
  Description of Artificial Sequence: Synthetic Construct
MAESRRKYYFPDVPDEQWYDWHWQVINRIRTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAELSGGQQLALEPPDLARKKRRSDKN

SEQ ID NO: 3513 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacccttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3514 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTLVVHAPGGGGKIPVAPNYVVSQSPRHVVLRNYEGVITTYTEPEDYHEECDCEDCRVDKHREGVAALSGGQQLALEPPDLARKKRRSDKN

SEQ ID NO: 3515 - DNA, 1251 bp, Artificial Sequence
  Description of Artificial Sequence: Synthetic Construct
atggcagaaagtcgtagaaagtattatttccctgatgccaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatgtatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3516 - protein, 416 aa, Artificial Sequence
  Description of Artificial Sequence: Synthetic Construct
MAESRRKYYFPDATDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYMYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKKRRSDKN

SEQ ID NO: 3517 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtagacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgtgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3518 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRRQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKKRRSDKN

SEQ ID NO: 3519 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggaggaggattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3520 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEEEDCEDCRVDKHREGVAALSGGQQLALEPPDLARKKRRSDKN

SEQ ID NO: 3521 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagaatgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3522 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEENDCEDCRVDKHREGVAALSGGQQLALEPPDLARKKRRSDKN

SEQ ID NO: 3523 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggcggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3524 - protein, 416 aa, Artificial Sequence; identical to SEQ ID NO: 2578
  Description of Artificial Sequence: Synthetic Construct

SEQ ID NO: 3525 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggcagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3526 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPAVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKKRRSDKN

SEQ ID NO: 3527 - DNA, 1251 bp, Artificial Sequence
  Description of Artificial Sequence: Synthetic Construct
atggcagaaagtcgtagaaagtattatttccctgatgtcaccgatgagcaatggcacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggggcgataagaactaa

SEQ ID NO: 3528 - protein, 416 aa, Artificial Sequence
  Description of Artificial Sequence: Synthetic Construct
MAESRRKYYFPDVTDEQWHDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKKRRGDKN

SEQ ID NO: 3529 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgatggggaggactgccgagtcgacaagcatcgtgagggcgtggctgcactttccggaggtcagcagttggctttagagcctcccgacttagctcgcaaaaaacgcaggagcgataagaactaa

SEQ ID NO: 3530 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDGEDCRVDKHREGVAALSGGQQLALEPPDLARKKRRSDKN

SEQ ID NO: 3531 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggacagtcgagtcgacaagcatcgtgagggcgtggctgcactttccggaggtcagcagttggctttagagcctcccgacttagctcgcaaaaaacgcaggagcgataagaactaa

SEQ ID NO: 3532 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDSRVDKHREGVAALSGGQQLALEPPDLARKKRRSDKN

SEQ ID NO: 3533 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttacccaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggaccgtcgagtcgacaagcatcgtgagggcgtggctgcactttccggaggtcagcagttggctttagagcctcccgacttagctcgcaaaaaacgcaggagcgataagaactaa

SEQ ID NO: 3534 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTQEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDRRVDKHREGVAALSGGQQLALEPPDLARKKRRSDKN

SEQ ID NO: 3535 - DNA, 1251 bp, Artificial Sequence
  Description of Artificial Sequence: Synthetic Construct
atggcagaaagtcgtagaaagtattatttccccgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3536 - protein, 416 aa, Artificial Sequence; identical to SEQ ID NO: 2578
  Description of Artificial Sequence: Synthetic Construct

SEQ ID NO: 3537 - DNA, 1251 bp, Artificial Sequence
  Description of Artificial Sequence: Synthetic Construct
atggcagaaagtcgtagaaagtattatttccctgatgtcactgatgagcaatggtacgactggcattggcaggtcatcaatcgaattaggacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcggagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctacactttccggaggtcagcagttggctttagagcctcccgacttagctcgcaaaaaacgcaggagcgataagaactaa

SEQ ID NO: 3538 - protein, 416 aa, Artificial Sequence
  Description of Artificial Sequence: Synthetic Construct
MAESRRKYYFPDVTDEQWYDWHWQVINRIRTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLRGVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVATLSGGQQLALEPPDLARKKRRSDKN

SEQ ID NO: 3539 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttccccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcggcaagcatcgtgagggcgtggctacactttccggaggtcagcagttggctttagagcctcccgacttagctcgcaaaaaacgcgggagcgataagaactaa

SEQ ID NO: 3540 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVGKHREGVATLSGGQQLALEPPDLARKKRGSDKN

SEQ ID NO: 3541 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaggacgctcgaccagctggagaagtacgttacactcaccgctgaggaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcggagtacctcatgtggagattgttcgtataggaagccgtgcgccggtagtcctccctcagcgtataacgcctcgattggtggatatgctcaaaaaatatcatccggtgtggctgaacactcacttcaaccacccgaatgaagttaccgaagaagcagtggaggcttgtggaagaatggccaatgccggtattccgttgggtaaccaaacagttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgaactttccggaggtcagcagttggctttagagcctcccgacttagctcgcaaaaaacgcaggagcgataagaactaa

SEQ ID NO: 3542 - protein, 416 aa, Artificial Sequence; identical to SEQ ID NO: 3442
  Description of Artificial Sequence: Synthetic Construct

SEQ ID NO: 3543 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaggacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcggagtacctcatgtggagattgttcgtataggaagccgtgcgccggtagtcctccctcagcgtataacgcctcgattggtggatatgctcaaaaaatatcatccggtgtggctgaacactcacttcaaccacccgaatgaagttaccgaagaagcagtggaggcttgtagaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgaactttccggaggtcagcagttggctttagagcctcccgacttagctcgcaaaaaacgcaggagcgataagaactaa

SEQ ID NO: 3544 - protein, 416 aa, Artificial Sequence
  Description of Artificial Sequence: Synthetic Construct
MAESRRKYYFPDVTDEQWYDWHWQVINRIRTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLRGVPHVEIVRIGSRAPVVLPQRITPRLVDMLKKYHPVWLNTHFNHPNEVTEEAVEACRRMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAELSGGQQLALEPPDLARKKRRSDKN

SEQ ID NO: 3545 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaggaagaagggggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggataaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcggagtacctcatgtggagattgttcgtataggaagccgtgcgccggtagtcctccctcagcgtataacgcctcgattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtgatacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcacgacttagctcgcaaaaaacgcaggagcgataagaactaa

SEQ ID NO: 3546 - protein, 416 aa, Artificial Sequence
  Description of Artificial Sequence: Synthetic Construct
MAESRRKYYFPDVTDEQWYDWHWQVINRIKTLDQLEKYVTLTAEEEGGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLRGVPHVEIVRIGSRAPVVLPQRITPRLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVIHAPGGGGKIPVAPNYVVSQSPRHVVLRNYEGVITTYTEPEDYHEECDCEDCRVDKHREGVAALSGGQQLALEPHDLARKKRRSDKN

SEQ ID NO: 3547 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcgcaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtggaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgaactttccggaggtcagcagttggctttagagcctcccgacttagctcgcaaaaaacgcaggagcgataagaactaa

SEQ ID NO: 3548 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAIAPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACGRMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAELSGGQQLALEPPDLARKKRRSDKN

SEQ ID NO: 3549 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcggagtacctcatgtggagattgttcgtataggaagccgtgcgccggtagccctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctctcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3550 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLRGVPHVEIVRIGSRAPVALPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKKRRSDKN

SEQ ID NO: 3551 - DNA, 1251 bp, Artificial Sequence
  Description of Artificial Sequence: Synthetic Construct
atggcagaaagtcgtagaaagtattatttccctgatgtcaccgatgagcaatggtgcgactggcattggcaggtcatcaatcgaattaagacgctcgaccagctggagaagtacgttacactcaccgctggggaagaagggggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctgtcgggaggcgatgccctccttgtcagcgacgaacgcttggaatacatattgaagcgtctgcgcggagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3552 - protein, 416 aa, Artificial Sequence
  Description of Artificial Sequence: Synthetic Construct
MAESRRKYYFPDVTDEQWCDWHWQVINRIKTLDQLEKYVTLTAGEEGGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLRGVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKKRRSDKN

SEQ ID NO: 3553 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccactcctactaaacgggaactggtacgtgctcctgaagatatggtagacccacttagtgaagatgaagattcgcccgtacccggactggctcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcggagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtggaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgaactttccggaggtcagcagttggctttagagcctcccgacttagctcgcaaaaaacgcaggagcgataagaactaa

SEQ ID NO: 3554 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQATPTKRELVRAPEDMVDPLSEDEDSPVPGLAHRYPDRVLFLITDKCSMYCRHCTRRRFAGQRDASSPSERIDRCIEYIANTPTVRDVLLSGGDALLVSDERLEYILKRLRGVPHVEIVRIGSRAPVVLPQRITPQLVDMLKKYHPVWLNTHFNHPNEVTEEAVEACGRMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAELSGGQQLALEPPDLARKKRRSDKN

SEQ ID NO: 3555 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaggacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcggagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatggggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3556 - protein, 416 aa, Artificial Sequence
  Description of Artificial Sequence: Synthetic Construct
MAESRRKYYFPDVTDEQWYDWHWQVINRIRTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLRGVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHGECDCEDCRVDKHREGVAALSGGQQLALEPPDLARKKRRSDKN

SEQ ID NO: 3557 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaggacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatacggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcggagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctacactttccggaggtcagcagttggctttagagcctcccgacttagctcgcaaaaaacgcaggagcgataagaactaa

SEQ ID NO: 3558 - protein, 416 aa, Artificial Sequence
  Description of Artificial Sequence: Synthetic Construct
MAESRRKYYFPDVTDEQWYDWHWQVINRIRTLDQLEKYVTLTAEEEEGVKESPKVLRMAITPYYLSLIDPENPNCPIRKQAIPTKRELVRAPEDTVDPLSEDEDSPVPGLTHRYPDRVLFLITDKCSMYCRHCTRRRFAGQRDASSPSERIDRCIEYIANTPTVRDVLLSGGDALLVSDERLEYILKRLRGVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVATLSGGQQLALEPPDLARKKRRSDKN

SEQ ID NO: 3559 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggcagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgatggggaggactgccgagtcgacaagcatcgtgagggcgtggctgcactttccggaggtcagcagttggctttagagcctcccgacttagctcgcaaaaaacgcaggagcgataagaactaa

SEQ ID NO: 3560 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPAVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDGEDCRVDKHREGVAALSGGQQLALEPPDLARKKRRSDKN

SEQ ID NO: 3561 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgggaggactgccgagtcgacaagcatcgtgagggcgtggctgcactttccggaggtcagcagttggctttagagcctcccgacttagctcgcaaaaaacgcaggagcgataagaactaa

SEQ ID NO: 3562 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDWEDCRVDKHREGVAALSGGQQLALEPPDLARKKRRSDKN

SEQ ID NO: 3563 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgataatgaggactgccgagtcgacaagcatcgtgagggcgtggctgcactttccggaggtcagcagttggctttagagcctcccgacttagctcgcaaaaaacgcaggagcgataagaactaa

SEQ ID NO: 3564 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDNEDCRVDKHREGVAALSGGQQLALEPPDLARKKRRSDKN

SEQ ID NO: 3565 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacgaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgatactgaggactgccgagtcgacaagcatcgtgagggcgtggctgcactttccggaggtcagcagttggctttagagcctcccgacttagctcgcaaaaaacgcaggagcgataagaactaa

SEQ ID NO: 3566 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDECSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDTEDCRVDKHREGVAALSGGQQLALEPPDLARKKRRSDKN

SEQ ID NO: 3567 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgatactgaggactgccgagtcgacaagcatcgtgagggcgtggctgcactttccggaggtcagcagttggctttagagcctcccgacttagctcgcaaaaaacgcaggagcgataagaactaa

SEQ ID NO: 3568 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDTEDCRVDKHREGVAALSGGQQLALEPPDLARKKRRSDKN

SEQ ID NO: 3569 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaggcgtctgcgcgtagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcatgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgatcatgaggactgccgagtcgacaagcatcgtgagggcgtggctgcactttccggaggtcagcagttggctttagagcctcccgacttagctcgcaaaaaacgcaggagcgataagaactaa

SEQ ID NO: 3570 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILRRLRVVPHVEIVRIGSRAPVVLPQRITPQLVDMLKKYHPVWLNTHFNHPNEVTEEAVEACERMANAGIPLGNQTVLLRGINDCTHVMKRLVHLLVKIHVRPYYIYACDLSLGIGHFRTPVSKGIEIIENLRGHTSGYAVPTFVVHAPGGGGKIPVAPNYVVSQSPRHVVLRNYEGVITTYTEPEDYHEECDHEDCRVDKHREGVAALSGGQQLALEPPDLARKKRRSDKN

SEQ ID NO: 3571 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgattgaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacctcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgatacggaggactgccgagtcgacaagcatcgtgagggcgtggctgcactttccggaggtcagcagttggctttagagcctcccgacttagctcgcaaaaaacgcaggagcgataagaactaa

SEQ ID NO: 3572 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHLNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDTEDCRVDKHREGVAALSGGQQLALEPPDLARKKRRSDKN

SEQ ID NO: 3573 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccacgatgttttgctatcgggaggcgatgccctccttgtcagcgacgaacgcttggaatacatattgaagcgtctgcgcgaagtacctcatgtggagattgttcgtataggaagtcgtgcgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3574 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVHDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKKRRSDKN

SEQ ID NO: 3575 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaatggcgcaggagcgataagaactaa

SEQ ID NO: 3576 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKWRRSDKN

SEQ ID NO: 3577 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaggccgcaggagcgataagaactaa

SEQ ID NO: 3578 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKGRRSDKN

SEQ ID NO: 3579 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaatacaggagcgataagaactaa

SEQ ID NO: 3580 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKKYRSDKN

SEQ ID NO: 3581 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaatgtaggagcgataagaactaa

SEQ ID NO: 3582 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKKCRSDKN

SEQ ID NO: 3583 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcgggagcgataagaactaa

SEQ ID NO: 3584 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKKRGSDKN

SEQ ID NO: 3585 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcgacagcgataagaactaa

SEQ ID NO: 3586 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKKRDSDKN

SEQ ID NO: 3587 - DNA, 1251 bp, Artificial Sequence
  Description of Artificial Sequence: Synthetic Construct
atggcagaaagtcgtagaaagtattacttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgccaaagcgataagaactaa

SEQ ID NO: 3588 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKKRQSDKN

SEQ ID NO: 3589 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggagcattaagaactaa

SEQ ID NO: 3590 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKKRRSIKN

SEQ ID NO: 3591 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaggtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggagcgataagcgttaa

SEQ ID NO: 3592 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKKRRSDKR

SEQ ID NO: 3593 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcggtatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3594 - protein, 416 aa, Artificial Sequence; identical to SEQ ID NO: 2578
  Description of Artificial Sequence: Synthetic Construct

SEQ ID NO: 3595 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcagcagcgataagaactaa

SEQ ID NO: 3596 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKKRSSDKN

SEQ ID NO: 3597 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcttccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggttcgataagaactaa

SEQ ID NO: 3598 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSSVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKKRRFDKN

SEQ ID NO: 3599 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcactgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3600 - protein, 416 aa, Artificial Sequence; identical to SEQ ID NO: 2578
  Description of Artificial Sequence: Synthetic Construct

SEQ ID NO: 3601 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggagcgttaagaactaa

SEQ ID NO: 3602 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKKRRSVKN

SEQ ID NO: 3603 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggagcgatttgaactaa

SEQ ID NO: 3604 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKKRRSDLN

SEQ ID NO: 3605 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcggtatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgcggaatcaatgattgtacacatgtgatgaagagattggtacatttgctggtaaagatccgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3606 - protein, 416 aa, Artificial Sequence; identical to SEQ ID NO: 2578
  Description of Artificial Sequence: Synthetic Construct

SEQ ID NO: 3607 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcgtgagcgataagaactaa

SEQ ID NO: 3608 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKKRVSDKN

SEQ ID NO: 3609 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggggtgataagaactaa

SEQ ID NO: 3610 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKKRRGDKN

SEQ ID NO: 3611 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggagcggtaagaactaa

SEQ ID NO: 3612 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKKRRSGKN

SEQ ID NO: 3613 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaagaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3614 - protein, 416 aa, Artificial Sequence; identical to SEQ ID NO: 2578
  Description of Artificial Sequence: Synthetic Construct

SEQ ID NO: 3615 - DNA, 1251 bp, Artificial Sequence
  Description of Artificial Sequence: Synthetic Construct
atggcagaaagtcgtagaaagtattatttccccgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacaatccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggagcgataagaactaa

SEQ ID NO: 3616 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTIRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKKRRSDKN

SEQ ID NO: 3617 - DNA, 1251 bp, Artificial Sequence
  Description of Artificial Sequence: Synthetic Construct
atggcagaaagtcgtagaaagtattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaaaggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaaaacgcaggagcgataaggcgtaa

SEQ ID NO: 3618 - protein, 416 aa, Artificial Sequence
  Description of Artificial Sequence: Synthetic Construct
MAESRRKYYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKKRRSDKA

SEQ ID NO: 3619 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgccacaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaagagcgataagaactaa

SEQ ID NO: 3620 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERKSDKN

SEQ ID NO: 3621 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccgggggactatcatgaggagtgcgattgtgaggactgccgagtcgacaagcatcgtgagggcgtggctgcactttccggaggtcagcagttggctttagagcctcccgacttagctcgcaaagaacgcaagagcgataagaactaa

SEQ ID NO: 3622 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPGDYHEECDCEDCRVDKHREGVAALSGGQQLALEPPDLARKERKSDKN

SEQ ID NO: 3623 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcatcgtgagggcgtggctgcactttccggaggtcagcagttggctttagagcctcccgacttagctcgcaaagaacgcaagagcgataagaactaa

SEQ ID NO: 3624 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHREGVAALSGGQQLALEPPDLARKERKSDKN

SEQ ID NO: 3625 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacacgcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaagagcgataagaactaa

SEQ ID NO: 3626 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERKSDKN

SEQ ID NO: 3627 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcataaagagggcgtggctgcactttccggaggtcagcagttggctttagagcctcccgacttagctcgcaaagaacgcaagagcgataagaactaa

SEQ ID NO: 3628 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHKEGVAALSGGQQLALEPPDLARKERKSDKN

SEQ ID NO: 3629 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagccgacaagcatcgtgagggcgtggctgcactttccggaggtcagcagttggctttagagcctcccgacttagctcgcaaagaacgcaagagcgataagaactaa

SEQ ID NO: 3630 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRADKHREGVAALSGGQQLALEPPDLARKERKSDKN

SEQ ID NO: 3631 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaagagcgataagaactaa

SEQ ID NO: 3632 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRVDKHREGVAALSGGQQLALEPPDLARKERKSDKN

SEQ ID NO: 3633 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatctatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaagagcgataagaactaa

SEQ ID NO: 3634 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQRDASSPSERIDLCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRVDKHREGVAALSGGQQLALEPPDLARKERKSDKN

SEQ ID NO: 3635 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagtcgacaagcataaagagggcgtggctgcactttccggaggtcagcagttggctttagagcctcccgacttagctcgcaaagaacgcaagttcgataagaactaa

SEQ ID NO: 3636 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRVDKHKEGVAALSGGQQLALEPPDLARKERKFDKN

SEQ ID NO: 3637 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagtcggcaagcatcgtgagggcgtggctgcactttccggaggtcagcagttggctttagagcctcccgacttagctcgcaaagaacgcaagttcgataagaactaa

SEQ ID NO: 3638 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRVGKHREGVAALSGGQQLALEPPDLARKERKFDKN

SEQ ID NO: 3639 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccgatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacctagctcgcaaagaacgcaagttcgataagaactaa

SEQ ID NO: 3640 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQKDASSPSERIDRCIEYIADTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRVDKHREGVAALSGGQQLALEPPDLARKERKFDKN

SEQ ID NO: 3641 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaagagcgataagaactaa

SEQ ID NO: 3642 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERKSDKN

SEQ ID NO: 3643 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaagttcgataagaactaa

SEQ ID NO: 3644 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRVDKHREGVAALSGGQQLALEPPDLARKERKFDKN

SEQ ID NO: 3645 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagtcggcaagcatcgtgagggcgtggctgcactttccggaggtcagcagttggctttagagcctcccgacttagctcgcaaagaacgcaagttcgataagaactaa

SEQ ID NO: 3646 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRVGKHREGVAALSGGQQLALEPPDLARKERKFDKN

SEQ ID NO: 3647 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagactcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagccgacaagcatcgtgagggcgtggctgcactttccggaggtcagcagttggctttagagcctcccgacttagctcgcaaagaacgcaggagcgataagaactaa

SEQ ID NO: 3648 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRADKHREGVAALSGGQQLALEPPDLARKERRSDKN

SEQ ID NO: 3649 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatctgctggtaaagattcgtgtgcgtccttactatatatatgcttgcgatctttcgcttgggatagggcatttccgcacgccggtatctaagggaaccgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3650 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGTEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 3651 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcggggggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcataaagagggcgtggctgcactttccggaggtcagcagttggctttagagcctcccgacttagctcgcaaagaacgcaagagcgataagaactaa

SEQ ID NO: 3652 - protein, 416 aa, Artificial Sequence; identical to SEQ ID NO: 3628
  Description of Artificial Sequence: Synthetic Construct

SEQ ID NO: 3653 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacccgtagcgccgaactatgttgtatctcagtccccacgacatgtggttcttcgcaattatgaaggtgttatcacaacctatacggagccggaggactatcatgaggagtgcgattgtgaggactgccgagccgacaagcatcgtgagggcgtggctgcactttccggaggtcagcagttggctttagagcctcccgacttagctcgcaaagaacgcaggttcgataagaactaa

SEQ ID NO: 3654 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRADKHREGVAALSGGQQLALEPPDLARKERRFDKN

SEQ ID NO: 3655 - DNA, 1251 bp, Artificial Sequence
  Description of Artificial Sequence: Synthetic Construct
atggcagaatgtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcataaagagggcgtggctgcactttccggaggtcagcagttggctttagagcctcccgacttagctcgcaaagaacgcaagttcgataagaactaa

SEQ ID NO: 3656 - protein, 416 aa, Artificial Sequence
  Description of Artificial Sequence: Synthetic Construct
MAECRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHKEGVAALSGGQQLALEPPDLARKERKFDKN

SEQ ID NO: 3657 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgtgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagtcgacaagcataaagagggcgtggctgcactttccggaggtcagcagttggctttagagcctcccgacttagctcgcaaagaacgcaggagcgataagaactaa

SEQ ID NO: 3658 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRVDKHKEGVAALSGGQQLALEPPDLARKERRSDKN

SEQ ID NO: 3659 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgctatcacaacctatacggagccggaggactatcatgaggagtgcgattgtgaggactgccgagtcgacaagcataaagagggcgtggctgcactttccggaggtcagcagttggctttagagcctcccgacttagctcgcaaagaacgcaagagcgataagaactaa

SEQ ID NO: 3660 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGAITTYTEPEDYHEECDCEDCRVDKHKEGVAALSGGQQLALEPPDLARKERKSDKN

SEQ ID NO: 3661 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggccatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcattgatcgatgcattgggtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcataaagagggcgtggctgcactttccggaggtcagcagttggctttagagcctcccgacttagctcgcaaagaacgcaggttcgataagaactaa

SEQ ID NO: 3662 - protein, 416 aa, Artificial Sequence
  Description of Artificial Sequence: Synthetic Construct
MAESRRKHYFPDVTDEQWYDWHWQAINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIGYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHKEGVAALSGGQQLALEPPDLARKERRFDKN

SEQ ID NO: 3663 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcataaagagggcgtggctgcactttccggaggtcagcagttggctttagagcctcccgacttagctcgcaaagaacgcaggagcgataagaactaa

SEQ ID NO: 3664 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHKEGVAALSGGQQLALEPPDLARKERRSDKN

SEQ ID NO: 3665 - DNA, 1251 bp, Artificial Sequence
  Description of Artificial Sequence: Synthetic Construct
atggcagaaggtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaagttcgataagaactaa

SEQ ID NO: 3666 - protein, 416 aa, Artificial Sequence
  Description of Artificial Sequence: Synthetic Construct
MAEGRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRVDKHREGVAALSGGQQLALEPPDLARKERKFDKN

SEQ ID NO: 3667 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctgtgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagtcgacaagcataaagagggcgtggctgcactttccggaggtcagcagttggctttagagcctcccgacttagctcgcaaagaacgcaggagcgataagaactaa

SEQ ID NO: 3668 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGCAVPTFVVHAPGGGGKIPVTPNYVVSQSPRHVVLRNYEGVITTYTEPEDYHEECDCEDCRVDKHKEGVAALSGGQQLALEPPDLARKERRSDKN

SEQ ID NO: 3669 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctgcggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaagaacgcaggagcgataagaactaa

SEQ ID NO: 3670 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAAGGGGKIPVTPNYVVSQSPRHVVLRNYEGVITTYTEPEDYHEECDCEDCRADKHKEGVAALSGGQQLALEPPDLARKERRSDKN

SEQ ID NO: 3671 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcataaagagggcgtggctgcactttccggaggtcagcagttggctttagagcctcccgacttagctcgcaaagaacgcaagagcgataagaactaa

SEQ ID NO: 3672 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHKEGVAALSGGQQLALEPPDLARKERKSDKN

SEQ ID NO: 3673 - DNA, 1251 bp, Artificial Sequence
  Description of Artificial Sequence: Synthetic Construct
atggcagaaagtcgtagaaagcgttatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgagtgaagttaccgaagaagcagtggaggcttgtgaaagaatggccaatgccggtattccgttgggtaaccaaacggttttattgcgtggaatcaatgattgtacacatgtgatgaagagattggtacatttgctggtaaaggttcgtgtgcgtccttactatatatatgcttgcgacctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcataaagagggcgtggctgcactttccggaggtcagcagttggctttagagcctcccgacttagctcgcaaagaacgcaggttcgataagaactaa

SEQ ID NO: 3674 - protein, 416 aa, Artificial Sequence
  Description of Artificial Sequence: Synthetic Construct
MAESRRKRYFPDVTDEQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPSEVTEEAVEACERMANAGIPLGNQTVLLRGINDCTHVMKRLVHLLVKVRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHKEGVAALSGGQQLALEPPDLARKERRFDKN

SEQ ID NO: 3675 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctcctcctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagtcaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaagagcgataagaactaa

SEQ ID NO: 3676 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPPERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERKSDKN

SEQ ID NO: 3677 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaagttcgataagaactaa

SEQ ID NO: 3678 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERKFDKN

SEQ ID NO: 3679 - DNA, 1251 bp, Artificial Sequence
  Description of Artificial Sequence: Synthetic Construct
atggcagaaagtcgtagagagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaacttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaagttcgataagaactaa

SEQ ID NO: 3680 - protein, 416 aa, Artificial Sequence
  Description of Artificial Sequence: Synthetic Construct
MAESRREHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRVDKHREGVAALSGGQQLALEPPDLARKERKFDKN

SEQ ID NO: 3681 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatgtatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacgacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaagagcgataagaactaa

SEQ ID NO: 3682 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYVYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERKSDKN

SEQ ID NO: 3683 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggttcgataagaactaa

SEQ ID NO: 3684 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRFDKN

SEQ ID NO: 3685 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaagagcgataagaactaa

SEQ ID NO: 3686 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRVDKHREGVAALSGGQQLALEPPDLARKERKSDKN

SEQ ID NO: 3687 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatggagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagccgacaagcatcgtgagggcgtggctgcactttccggaggtcagcagttggctttagagcctcccgacttagctcgcaaagaacgcaagagcgataagaactaa

SEQ ID NO: 3688 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMERLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRADKHREGVAALSGGQQLALEPPDLARKERKSDKN

SEQ ID NO: 3689 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtattacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaagttcgataagaactaa

SEQ ID NO: 3690 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRVDKHREGVAALSGGQQLALEPPDLARKERKFDKN

SEQ ID NO: 3691 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatggaccccgagaatcctaactgtccgattcgtaaacaagccattcctactaaacgggaactggtacgtgctcctgaagatatggtagacccacttagtgaagatgaagattcgcccgtacccggactgactcatcgttatccggatcgtgtattgttcctcatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcgattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3692 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLMDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPRLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 3693 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagacgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcgattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacaccacgggctatgctgttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3694 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPRLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTTGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 3695 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactaaacgggaactggtacgtgctcctgaagatatggtagacccacttagtgaagatgaagattcgcccgtacccggactgactcatcgttatccggatcgtgtattgttcctcatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcggtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccgatatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3696 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPISKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 3697 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagctattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcgattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacaccacgggctatgctgttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3698 - protein, 416 aa, Artificial Sequence; identical to SEQ ID NO: 3694
  Description of Artificial Sequence: Synthetic Construct

SEQ ID NO: 3699 - DNA, 1251 bp, Artificial Sequence
  Description of Artificial Sequence: Synthetic Construct
atggcagaaagtcgtagagagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcggtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacaccacgggctatgcagttcctacctttgtggtacatgctccggggggtggtggtaagatacctgtggcgccgaactatgttgtatctcagtccccacgacatgtggttcttcgcaattatgaaggtgttatcacaacctatacggagccggaggactatcatggggagtgcgattgtgaggactgccgagtcgacaagcatcgtgagggcgtggctgcactctccggaggtcagcagttggctttagagcctcccgacttagctcgcaaagaacgcaggagcgataagaactaa

SEQ ID NO: 3700 - protein, 416 aa, Artificial Sequence
  Description of Artificial Sequence: Synthetic Construct
MAESRREHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTTGYAVPTFVVHAPGGGGKIPVAPNYVVSQSPRHVVLRNYEGVITTYTEPEDYHGECDCEDCRVDKHREGVAALSGGQQLALEPPDLARKERRSDKN

SEQ ID NO: 3701 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcgattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacgcatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtggcgccgaactatgtcgtatctcagtccccacgacatgtggttcttcgcaattatgaaggtgttatcacaacctatacggagccggaggactatcatggggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3702 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPRLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHGECDCEDCRVDKHREGVAALSGGQQLALEPPDLARKERRSDKN

SEQ ID NO: 3703 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggtgatgccctccttgtcagcgacgaacgcttggaatacatattgaagcgcctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacgcatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtggcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3704 - protein, 416 aa, Artificial Sequence; identical to SEQ ID NO: 3260
  Description of Artificial Sequence: Synthetic Construct

SEQ ID NO: 3705 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggtgatgccctccttgtcagcgacgaacgcttggaatacatactgaagcgtctgcgcgaagtacctcatgtggagattgttcgtataggaagccgtgcgccggtagtcctccctcagcgtataacgcctcgattggtggatatgctcaaaaaatatcatccggtgtggctgaacactcacttcaaccacccgaatgaagttaccgaagaagcggtggaggcttgtgaaagaatggccaatgccggtattccgttgggtaaccaaacggttttattgcgtggaatcaatgattgtacgcatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcggttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3706 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPRLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 3707 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaggccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggtgatgccctccttgtcagcgacgaacgcttggaatacatattgaagcgtctgcgcgaagtacctcatgtggagattgttcgtataggaagccgtgcgccggtagtcctccctcagcgtataacgcctcgattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcggttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3708 - protein, 416 aa, Artificial Sequence; identical to SEQ ID NO: 3706
  Description of Artificial Sequence: Synthetic Construct

SEQ ID NO: 3709 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagaggttggtacatttgctggtaaagattcgtgtgcgtccttactacatatatgcttgcgatctttcgcttggaatagggcatttccgcacgccggtatctaagggaatcgaaattatcgaaaatttgcgcggacacaccacgggctatgcagttcctacctttgtggtacatgctccggggggtggtggtaagatacctgtagcgccgaactatgttgtatctcagtccccacgacatgtgattcttcgcaattatgaaggtgttatcacaacctatacggagccggaggactatcatgaggagtgcgattgtgaggactgccgagtcgacaagcatcgtgagggcgtggctgcactttccggaggtcagcagttggccttagagcctcccgacttagctcgcaaagaacgcaggagcgataagaactaa

SEQ ID NO: 3710 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTTGYAVPTFVVHAPGGGGKIPVAPNYVVSQSPRHVILRNYEGVITTYTEPEDYHEECDCEDCRVDKHREGVAALSGGQQLALEPPDLARKERRSDKN

SEQ ID NO: 3711 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggtgatgccctccttgtccgcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacgcatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtggcgccgaactatgtcgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3712 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVRDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 3713 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcgattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacgcatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtgattcttcgcaattatgaaggtgttatcacaacctatacggagccggaggactatcatggggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3714 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPRLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVILRNYEGVITTYTEPEDYHGECDCEDCRVDKHREGVAALSGGQQLALEPPDLARKERRSDKN

SEQ ID NO: 3715 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggtgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcggtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagccgacaagcatcgtgagggcgtggctgcactttccggaggtcagcagttggctttagagcctcccgacttagctcgcaaagaacgcaggagcgataagaactaa

SEQ ID NO: 3716 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRADKHREGVAALSGGQQLALEPPDLARKERRSDKN

SEQ ID NO: 3717 - DNA, 1251 bp, Artificial Sequence
  Description of Artificial Sequence: Synthetic Construct
atggcagaaagtcgtagaaagcattatttccctggtgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgccgcttcgcaggacagagagatacttcttctccttctgagcgcatcgatcgatgcattgagtatatagccaatacaccgacagtccgcgatgttttgctatcgggaggtgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacgcacgtgatgaagaggttggtacatttgctggtaaagattcgtgtgcgtccttactatatatatgcttgcgatctttcgcttggaatagggcatttccgcacgccgatatctaagggaatcgaaattatcgaaaatttgcgcggacacacctcgggctatgcagttcctacctttgtggtacatgctccggggggtggtggtaagatacctgtggcgccgaactatgtcgtatctcagtccccacgacatgtggttcttcgcaattatgaaggtgttatcacaacctatacggagccggaggactatcatggggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3718 - protein, 416 aa, Artificial Sequence
  Description of Artificial Sequence: Synthetic Construct
MAESRRKHYFPGVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDTSSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPISKGIEIIENLRGHTSGYAVPTFVVHAPGGGGKIPVAPNYVVSQSPRHVVLRNYEGVITTYTEPEDYHGECDCEDCRVDKHREGVAALSGGQQLALEPPDLARKERRSDKN

SEQ ID NO: 3719 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaactgtccgattcgtaaacaagccattcctactaaacgggagctggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagaggttggtacatttgctggtaaagattcgtgtgcgtccttactacatatatgcttgcgatctttcgcttggaatagggcatttccgcacgccgatatctaagggaatcgaaattatcgaaaatttgcgcggacacaccacgggctatgcagttcctacctttgtggtacatgctccggggggtggtggtaagatacctgtagcgccgaactatgtcgtatctcagtccccacgacatgtggttcttcgcaattatgaaggtgttatcacaacctatacggagccggaggactatcatggggagtgcgattgtgaggactgccgagccgacaagcatcgtgagggcgtggctgcactttccggaggtcagcagttggctttagagcctcccgacttagctcgcaaagaacgcaggagcgataagaactaa

SEQ ID NO: 3720 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPISKGIEIIENLRGHTTGYAVPTFVVHAPGGGGKIPVAPNYVVSQSPRHVVLRNYEGVITTYTEPEDYHGECDCEDCRADKHREGVAALSGGQQLALEPPDLARKERRSDKN

SEQ ID NO: 3721 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactaaacgggaactggtacgtgctcctgaagatatggtagacccacttagtgaagatgaagattcgcccgtacccggactgactcatcgttatccggatcgtgtattgttcctcatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtaccccatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatggcggtattccgttgggtaaccaaacggttttattgcgtggaatcaatgattgtacgcatgtgatgaagaggttggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgtcgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3722 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANGGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 3723 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcgattggtggatatgctcaaaaaatatcatccggtgtggctgaacactcacttcaaccacccgaatgaagttaccgaagaagcggtggaggcttgtgaaagaatggccaatgccggtattccgttgggtaaccaaacggttttattgcgtggaatcaatgattgtacacatgtgatgaagaggttggtacatttgctggtaaagattcgtgtgcgtccttactacatatatgcttgcgatctttcgcttggaatagggcatttccgcacgccgatatctaagggaatcgaaattatcgaaaatttgcgcggacacacctcgggctacgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3724 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPRLVDMLKKYHPVWLNTHFNHPNEVTEEAVEACERMANAGIPLGNQTVLLRGINDCTHVMKRLVHLLVKIRVRPYYIYACDLSLGIGHFRTPISKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 3725 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaaccgcccaaagtactccgaatggctatcacgccttattatttgagtttgatagaccccgagaatcctaactgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacgcacgtgatgaagaggttggtacatttgctggtaaagattcgtgtgcgtccttactacatatatgcttgcgatctttcgcttggaatagggcatttccgcacgccggtatctaagggaatcgaaattatcgaaaatttgcgcggacacaccacgggctatgcagttcctacctttgtggtacatgctccggggggtggtggtaagatacctgtggcgccgaactatgtcgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3726 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKEPPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTTGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 3727 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccggttcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggtgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3728 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPVRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 3729 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaggctattcctactaaacgggaactggtacgtgctcctgaagatatggtagacccacttagtgaagatgaagattcgcccgtacccggactgactcatcgttatccggatcgtgtattgttcctcatcacggacaaatgttcgatgtactgtcgtcattgtactcgccgtcgcttcgcaggacagagagacgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagaggttggtacatttgctggtaaagattcgtgtgcgtccttactatatatatgcttgcgatctttcgcttggaatagggcatttccgcacgccggtatctaagggaatcgaaattatcgaaaatttgcgcggacacaccacgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagccgacaagcatcgtgagggcgtggctgcactttccggaggtcagcagttggctttagagcctcccgacttagctcgcaaagaacgcaggagcgataagaactaa

SEQ ID NO: 3730 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTTGYAVPTFVVHAPGGGGKIPVAPNYVVSQSPRHVVLRNYEGVITTYTEPEDYHEECDCEDCRADKHREGVAALSGGQQLALEPPDLARKERRSDKN

SEQ ID NO: 3731 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaactgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccgatatctaagggaatcgaaattatcgaaaatttgcgcggacacacctcgggctatgcagttcctacctttgtggtacaagctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3732 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPISKGIEIIENLRGHTSGYAVPTFVVQAPGGGGKIPVAPNYVVSQSPRHVVLRNYEGVITTYTEPEDYHEECDCEDCRVDKHREGVAALSGGQQLALEPPDLARKERRSDKN

SEQ ID NO: 3733 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcggtggaggcttgtgaaagaatggccaatgccggtattccgttgggtaaccaaacggttttattgcgtggaatcaatgattgtacgcacgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacaccacgggctatgcagttcctacctttgtggtacatgctccggggggtggtggtaagatacctgtagcgccgagctatgttgtatctcagtccccacgacatgtggttcttcgcaattatgaaggtgttatcacaacctatacggagccggaggactatcatggggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3734 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTTGYAVPTFVVHAPGGGGKIPVAPSYVVSQSPRHVVLRNYEGVITTYTEPEDYHGECDCEDCRVDKHREGVAALSGGQQLALEPPDLARKERRSDKN

SEQ ID NO: 3735 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactaaacgggaactggtacgtgctcctgaagatatggtagacccacttagtgaagatgaagattcgcccgtacccggactgactcatcgttatccggatcgtgtattgttcctcatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacgcacgtgatgaagaggttggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatggggagtgcgattgtgaggactgccgagccgacaagcatcgtgagggcgtggctgcactttccggaggtcagcagttggctttagagcctcccgacttagctcgcaaagaacgcaggagcgataagaactaa

SEQ ID NO: 3736 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHGECDCEDCRADKHREGVAALSGGQQLALEPPDLARKERRSDKN

SEQ ID NO: 3737 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttcctcatcacggacaaatgttcgatgtactgtcgtcattgtactcgccgtcgcttcgcgggacagagagacgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacgcatgtgatgaagagattggtacatttgctggtaaagattcgtgtgcgtccttactatatatatgcttgcgatctttcgcttggaatagggcatttccgcacgccgatatctaagggaatcgaaattatcgaaaatttgcgcgggcacacctcgggctatgcagttcctacctttgtggtacatgctccggggggtggtggtaagatacctgtggcgccgaactatgttgtatctcagtccccacgacatgtggttcttcgcaattatgaaggtgttatcacaacctatacggagccggaggactatcatggggagtgcgattgtgaggactgccgagtcgacaagcatcgtgagggcgtggctgcactttccggaggtcagcagttggctttagagcctcccgacttagctcgcaaagaacgcaggagcgataggaactaa

SEQ ID NO: 3738 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPISKGIEIIENLRGHTSGYAVPTFVVHAPGGGGKIPVAPNYVVSQSPRHVVLRNYEGVITTYTEPEDYHGECDCEDCRVDKHREGVAALSGGQQLALEPPDLARKERRSDRN

SEQ ID NO: 3739 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaggccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacgcacgtaatgaagaggttggtacatttgctggtaaagattcgtgtgcgtccttactacatatatgcttgcgatctttcgcttggaatagggcatttccgcacgccaatatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtgattcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3740 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPISKGIEIIENLRGHTSGYAVPTFVVHAPGGGGKIPVAPNYVVSQSPRHVILRNYEGVITTYTEPEDYHEECDCEDCRVDKHREGVAALSGGQQLALEPPDLARKERRSDKN

SEQ ID NO: 3741 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacgcatgtgatgaagaggttggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcggttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3742 - protein, 416 aa, Artificial Sequence; identical to SEQ ID NO: 3260
  Description of Artificial Sequence: Synthetic Construct

SEQ ID NO: 3743 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaggccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggtgatgccctccttgtcagcgacgaacgcttggaatacatattgaagcgtctgcgcgaagtacctcatgtggagattgttcgtataggaagccgtgcgccggtagtcctccctcagcgtataacgcctcgattggtggatatgctcaaaaaatatcatccggtgtggctgaacactcacttcaaccacccgaatgaagttaccgaagaagcggtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccgatatctaagggaatcgaaattatcgaaaatttgcgcggacacacctcgggctatgcagttcctacctttgtggtacatgctccggggggtggtggtaagatacctgtagcgccgaactatgtcgtatctcagtccccacgacatgtggttcttcgcaattatgaaggtgttatcacaacctatacggagccggaggactatcatggggagtgcgattgtgaggactgccgggtcgacaagcatcgtgggggcgtggctgcactttccggaggtcagcagttggctttagagcctcccgacttagctcgcaaagaacgcaggagcgataagaactaa

SEQ ID NO: 3744 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPRLVDMLKKYHPVWLNTHFNHPNEVTEEAVEACERMANAGIPLGNQTVLLRGINDCTHVMKRLVHLLVKIRVRPYYIYACDLSLGIGHFRTPISKGIEIIENLRGHTSGYAVPTFVVHAPGGGGKIPVAPNYVVSQSPRHVVLRNYEGVITTYTEPEDYHGECDCEDCRVDKHRGGVAALSGGQQLALEPPDLARKERRSDKN

SEQ ID NO: 3745 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttcctcatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggtgatgccctccttgtcagcgacgaacgcttggaatacatattgaagcgtctgcgcgaagtacctcatgtggagattgttcgtataggaagccgtgcgccggtagtcctcccccagcgtataacgcctcaattggtggatatgctcaaaaaacatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacgcatgtgatgaagaggttggtacatttgctggtaaagattcgtgtgcgtccttactatatatatgcttgcgatctttcgcttggaatagggcatttccgcacgccgatatctaagggaatcgaaattatcgaaaatttgcgcggacacaccacgggctatgcagttcctacctttgtggtacatgctccggggggtggtggtaagatacctgtggcgccgaactatgttgtatctcagtccccacgacatgtggttcttcgcaattatgaaggtgttatcacaacctatacggagccggaggactatcatggggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3746 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKHHPVWLNTHFNHPNEVTEEAVEACERMANAGIPLGNQTVLLRGINDCTHVMKRLVHLLVKIRVRPYYIYACDLSLGIGHFRTPISKGIEIIENLRGHTTGYAVPTFVVHAPGGGGKIPVAPNYVVSQSPRHVVLRNYEGVITTYTEPEDYHGECDCEDCRVDKHREGVAALSGGQQLALEPPDLARKERRSDKN

SEQ ID NO: 3747 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaactgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagacgcttcttctccttctgagcgcatcgatcgatgcattgagtatatagccaatacaccgacagtccgcgatgttttgctatcgggaggcgatgccctccttgccagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagaggttggtacatttgctggtaaagattcgtgtgcgtccttactacatatatgcttgcgatctttcgcttggaatagggcatttccgcacgccgatatctaagggaatcgaaattatcgaaaatttgcgcggacacacctcgggctatgctgttcctacctttgtggtacatgctccggggggtggtggtaagatacctgtagcgccgaactatgtcgtatctcagtccccacgacatgtgattcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3748 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLASDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPISKGIEIIENLRGHTSGYAVPTFVVHAPGGGGKIPVAPNYVVSQSPRHVILRNYEGVITTYTEPEDYHEECDCEDCRVDKHREGVAALSGGQQLALEPPDLARKERRSDKN

SEQ ID NO: 3749 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagttggagaagtacgttacactcaccgctgaagaagaagagggagtaaaagaatcgcccaaagtactccgaatggctatcacgccttattatttgagtttgatagaccccgagaatcctaattgtccgattcgtaaacaggccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccgctgtggctgaacactcacttcaaccacccgaatgaagttaccgaagaagcggtggaggcttgtgaaagaatggccaatgccggtattccgttgggtaaccaaacggttttattgcgtggaatcaatgattgtacgcatgtgatgaagagattggtacatttgctggtaaagattcgtgtgcgtccttactacatatatgcttgcgatctttcgcttggaatagggcatttccgcacgccgatatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtgattcttcgcaattatgaaggtgttatcacaacctatacggagccggaggactatcatgaggagtgcgactgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3750 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPLWLNTHFNHPNEVTEEAVEACERMANAGIPLGNQTVLLRGINDCTHVMKRLVHLLVKIRVRPYYIYACDLSLGIGHFRTPISKGIEIIENLRGHTSGYAVPTFVVHAPGGGGKIPVAPNYVVSQSPRHVILRNYEGVITTYTEPEDYHEECDCEDCRVDKHREGVAALSGGQQLALEPPDLARKERRSDKN

SEQ ID NO: 3751 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaggctattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacgcacgtgatgaagaggttggtacatttgctggtaaagattcgtgtgcgtccttactacatatatgcttgcgatctttcgcttggaatagggcatttccgcacgccggtatctaagggaatcgaaattatcgaaaatttgcgcggacacaccacgggctatgctgttcctacctttgtggtacatgctccggggggtggtggtaagatacctgtagcgccgaactatgtcgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3752 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTTGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 3753 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaggctattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgcataacgcctcaattggtggatatgctcaaaaaatatcatccggtgtggctgaacactcacttcaaccacccgaatgaagttaccgaagaagcggtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatggggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3754 - protein, 416 aa, Artificial Sequence; identical to SEQ ID NO: 3270
  Description of Artificial Sequence: Synthetic Construct

SEQ ID NO: 3755 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagctattcctactaaacgggaactggtacgtgctcctgaagatatggtagacccacttagtgaagatgaagattcgcccgtacccggactgactcatcgttatccggatcgtgtattgttcctcatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcggtggaggcttgtgaaagaatggccaatgccggtattccgttgggtaaccaaacggttttattgcgtggaatcaatgattgtacgcacgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtggcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3756 - protein, 416 aa, Artificial Sequence; identical to SEQ ID NO: 3260
  Description of Artificial Sequence: Synthetic Construct

SEQ ID NO: 3757 - DNA, 1251 bp, Artificial Sequence
  Description of Artificial Sequence: Synthetic Construct
atggcagaaagtcgtagaaagcattatttccctgatgtcaccgatgagcaatggtatgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaactgtccgattcgtaaacaagccattcctactaaacgggaactggtacgtgctcctgaagatatggtagacccacttagtgaagatgaagattcgcccgtacccggactgactcatcgttatccggatcgtgtattgttcctcatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcgattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcattaccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatggggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3758 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPRLVDMLKKYHPVWLNTHFNHPNEVTEEAVEACERMANAGIPLGNQTVLLRGINDCTHVMKRLVHLLVKIRVRPYYIYACDLSLGIGHYRTPVSKGIEIIENLRGHTSGYAVPTFVVHAPGGGGKIPVAPNYVVSQSPRHVVLRNYEGVITTYTEPEDYHGECDCEDCRVDKHREGVAALSGGQQLALEPPDLARKERRSDKN

SEQ ID NO: 3759 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaactgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacacgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcggttgtgaggactgccgagccgacaagcatcgtgagggcgtggctgcactttccggaggtcagcagttggctttagagcctcccgacttagctcgcaaagaacgcaggagcgataagaactaa

SEQ ID NO: 3760 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECGCEDCRADKHREGVAALSGGQQLALEPPDLARKERRSDKN

SEQ ID NO: 3761 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaactgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcggtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcggttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3762 - protein, 416 aa, Artificial Sequence; identical to SEQ ID NO: 3260
  Description of Artificial Sequence: Synthetic Construct

SEQ ID NO: 3763 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggggaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccgatatctaagggaatcgaaattatcgaaaatttgcgcggacacacctcgggctatgctgttcctacctttgtggtacatgctccggggggtggtggtaagatacctgtggcgccgaactatgtcgtatctcagtccccacgacatgtgattcttcgcaattatgaaggtgttatcacaacctatacggagccggaggactatcatggggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3764 - protein, 416 aa, Artificial Sequence
  Description of Artificial Sequence: Synthetic Construct
MAESRRKHYFPDVTDEQWYDWHWQVINRIKTLDQLGKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPISKGIEIIENLRGHTSGYAVPTFVVHAPGGGGKIPVAPNYVVSQSPRHVILRNYEGVITTYTEPEDYHGECDCEDCRVDKHREGVAALSGGQQLALEPPDLARKERRSDKN

SEQ ID NO: 3765 - DNA, 1251 bp, Artificial Sequence
  Description of Artificial Sequence: Synthetic Construct
atggcagaaagtcgtagaaagcattatttccctgatgtcaccgatgagcaatggcacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttcctcatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggtgatgccctccttgtcagcgacgaacgcttggaatacatattgaagcgtatgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagaggttggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcggttcctacctttgtggtacatgctccggggggtggtggtaagatacctgtggcgccgaactatgtcgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3766 - protein, 416 aa, Artificial Sequence
  Description of Artificial Sequence: Synthetic Construct
MAESRRKHYFPDVTDEQWHDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRMREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 3767 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaactgtccgattcgtaaacaagccattcctactaaacgggaactggtacgtgctcctgaagatatggtagacccacttagtgaagatgaagattcgcccgtacccggactgactcatcgttatccggatcgtgtattgttcctcatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacgcatgtgatgaagaggttggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgtcgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3768 - protein, 416 aa, Artificial Sequence; identical to SEQ ID NO: 3260
  Description of Artificial Sequence: Synthetic Construct

SEQ ID NO: 3769 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagctattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggtgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcggtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccgatatctaagggaatcgaaattatcgaaaatttgcgcggacatacctcgggctatgctgttcctacctttgtggtacatgctccggggggtggtggtaagatacctgtggcgccgaactatgttgtatctcagtccccacgacatgtggttcttcgcaattatgaaggtgttatcacaacctatacggagccggaggactatcatggggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3770 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPISKGIEIIENLRGHTSGYAVPTFVVHAPGGGGKIPVAPNYVVSQSPRHVVLRNYEGVITTYTEPEDYHGECDCEDCRVDKHREGVAALSGGQQLALEPPDLARKERRSDKN

SEQ ID NO: 3771 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaggctattcctactaaacgggaactggtacgtgctcctgaagatatggtagacccacttagtgaagatgaagattcgcccgtacccggactgactcatcgttatccggatcgtgtattgttcctcatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcggtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacaccacgggctatgcggttcctacctttgtggtacatgctccggggggtggtggtaagatacctgtggcgccgaactatgtcgtatctcagtccccacgacatgtgattcttcgcaattatgaaggtgttatcacaacctatacggagccggaggactatcatggggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3772 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTTGYAVPTFVVHAPGGGGKIPVAPNYVVSQSPRHVILRNYEGVITTYTEPEDYHGECDCEDCRVDKHREGVAALSGGQQLALEPPDLARKERRSDKN

SEQ ID NO: 3773 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaggctattcctactaaacgggaactggtacgtgctcctgaagatatggtagacccacttagtgaagatgaagattcgcccgtacccggactgactcatcgttatccggatcgtgtattgttcctcatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcgattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacgcatgtgatgaagagattggtacatttgctggtaaagattcgtgtgcgtccttactatatatatgcttgcgatctttcgcttggaatagggcatttccgcacgccgatatctaagggaatcgaaattatcgaaaatttgcgcggacacaccacgggctatgcagttcctacctttgtggtacatgctccggggggtggtggtaagatacctgtagcgccgaactatgttgtatctcagtccccacgacatgtgattcttcgcaattatgaaggtgttatcacaacctatacggagccggaggactatcatgaggagtgcgattgtgaggactgccgagccgacaagcatcgtgagggcgtggctgcactttccggaggtcagcagttggctttagagcctcccgacttagctcgcaaagaacgcaggagcgataagaactaa

SEQ ID NO: 3774 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPRLVDMLKKYHPVWLNTHFNHPNEVTEEAVEACERMANAGIPLGNQTVLLRGINDCTHVMKRLVHLLVKIRVRPYYIYACDLSLGIGHFRTPISKGIEIIENLRGHTTGYAVPTFVVHAPGGGGKIPVAPNYVVSQSPRHVILRNYEGVITTYTEPEDYHEECDCEDCRADKHREGVAALSGGQQLALEPPDLARKERRSDKN

SEQ ID NO: 3775 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttcctcatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcggtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgtcgtatctcagtccccacgacaagtggttcttcgcaattatgaaggtgttatcacaacctatacggagccggaggtctatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3776 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRQVVLRNYEGVITTYTEPEVYHEECDCEDCRVDKHREGVAALSGGQQLALEPPDLARKERRSDKN

SEQ ID NO: 3777 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactaaacgggaactggtacgtgctcctgaagatatggtagacccacttagtgaagatgaagattcgcccgtacccggactgactcatcgttatccggatcgtgtattgttcctcatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcgattggtggatatgctcaaaaaatatcatccggtgtggctgaacactcacttcaaccacccgaatgaagttaccgaagaagcggtggaggcttgtgaaagaatggccaatgccggtattccgttgggtaaccaaacggttttattgcgtggaatcaatgattgtacgcatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtgattcttcgcaattatgaaggtgttatcacaacctatacggagccggaggactatcatggggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3778 - protein, 416 aa, Artificial Sequence; identical to SEQ ID NO: 3714
  Description of Artificial Sequence: Synthetic Construct

SEQ ID NO: 3779 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagacgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcgattggtggatatgctcaaaaaatatcatccggtgtggctgaacactcacttcaaccacccgaatgaagttaccgaagaagcggtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtggcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3780 - protein, 416 aa, Artificial Sequence; identical to SEQ ID NO: 3706
  Description of Artificial Sequence: Synthetic Construct

SEQ ID NO: 3781 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacgcacgtgatgaagaggttggtacatttgctggtaaagattcgtgtgcgtccttactacatatatgcttgcgatctttcgcttggaatagggcatttccgcacgccgatatctaagggaatcgaaattatcgaaaatttgcgcggacacaccacgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3782 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPISKGIEIIENLRGHTTGYAVPTFVVHAPGGGGKIPVTPNYVVSQSPRHVVLRNYEGVITTYTEPEDYHEECDCEDCRVDKHREGVAALSGGQQLALEPPDLARKERRSDKN

SEQ ID NO: 3783 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaactgtccgattcgtaaacaagccattcctactaaacgggaactggtacgtgctcctgaagatatggtagacccacttagtgaagatgaagattcgcccgtacccggactgactcatcgttatccggatcgtgtattgttcctcatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagaggttggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcggttcctacctttgtggtacatgctccggggggtggtggtaagatacctgtagcgccgaactatgtcgtatctcagtccccacgacatgtgattcttcgcaattatgaaggtgttatcacaacctatacggagccggaggactatcatggggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3784 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVILRNYEGVITTYTEPEDYHGECDCEDCRVDKHREGVAALSGGQQLALEPPDLARKERRSDKN

SEQ ID NO: 3785 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttcctcatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccagtgtggctgaacactcacttcaaccacccgaatgaagttaccgaagaagcggtggaggcttgtgaaagaatggccaatgccggtattccgttgggtaaccaaacggttttattgcgtggaatcaatgattgtacgcatgtgatgaagaggttggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcggttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatggggagtgcgattgtgaggactgccgagccgacaagcatcgtgagggcgtggctgcactttccggaggtcagcagttggctttagagcctcccgacttagctcgcaaagaacgcaggagcgataagaactaa

SEQ ID NO: 3786 - protein, 416 aa, Artificial Sequence; identical to SEQ ID NO: 3736
  Description of Artificial Sequence: Synthetic Construct

SEQ ID NO: 3787 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactaaacgggaactggtacgtgctcctgaagatatggtagacccacttagtgaagatgaagattcgcccgtacccggactgactcatcgttatccggatcgtgtattgttcctcatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcggtggaggcttgtgaaagaatggccaatgccggtattccgttgggtaaccaaacggttttattgcgtggaatcaatgattgtacacacgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3788 - protein, 416 aa, Artificial Sequence; identical to SEQ ID NO: 3260
  Description of Artificial Sequence: Synthetic Construct

SEQ ID NO: 3789 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaggccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgccgcttcgcgggacagagagacgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgtcgtatctcagtccccacgacatgtgattcttcgcaattatgaaggtgttatcacaacctatacggagccggaggactatcatggggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3790 - protein, 416 aa, Artificial Sequence; identical to SEQ ID NO: 3784
  Description of Artificial Sequence: Synthetic Construct

SEQ ID NO: 3791 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttcctcatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacgcatgtgatgaagaggttggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacagcctatacggagccggaggactatcatggggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3792 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITAYTEPEDYHGECDCEDCRVDKHREGVAALSGGQQLALEPPDLARKERRSDKN

SEQ ID NO: 3793 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttcctcatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggtgatgccctccttgtcagcgacgaacgcttggaatacatattgaagcgtctgcgcgaagtacctcatgtggagattgttcgtataggaagccgtgcgccggtagtcctccctcagcgtataacgcctcgattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgctgttcctacctttgtggtacatgctccggggggtggtggtaagatacctgtagcgccgaactatgtggtatctcagtccccacgacatgtgattcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3794 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPRLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVILRNYEGVITTYTEPEDYHEECDCEDCRVDKHREGVAALSGGQQLALEPPDLARKERRSDKN

SEQ ID NO: 3795 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaactgtccgattcgtaaacaagccattcctactaaacgggaactggtacgtgctcctgaagatatggtagacccacttagtgaagatgaagattcgcccgtacccggactgactcatcgttatccggatcgtgtattgttcctcatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgcataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacacgtgatgaagaggttggtacatttgctggtaaagattcgtgtgcgtccttactacatatatgcttgcgatctttcgcttggaataggacatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatggggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3796 - protein, 416 aa, Artificial Sequence; identical to SEQ ID NO: 3270
  Description of Artificial Sequence: Synthetic Construct

SEQ ID NO: 3797 - DNA, 1251 bp, Artificial Sequence
  Description of Artificial Sequence: Synthetic Construct
atggcagaaagtcgtagaaagcattatttccctgatgtcaccgatgagcagtggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaggctattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctaagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcgattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacacgtgatgaagaggttggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcggttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3798 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSKRIDRCIEYIANTPTVRDVLLSGGDALLVSDERLEYILKRLREVPHVEIVRIGSRAPVVLPQRITPRLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 3799 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgatgcgtaaacaggccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgctgttcctacctttgtggtacatgctccggggggtggtggtaagatacctgtagcgccgaactatgttgtatctcagtccccacgacatgtgattcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3800 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPMRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVILRNYEGVITTYTEPEDYHEECDCEDCRVDKHREGVAALSGGQQLALEPPDLARKERRSDKN

SEQ ID NO: 3801 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacgcacgtgatgaagaggttggtacatttgctggtaaagattcgtgtgcgtccttactacatatatgcttgcgatctttcgcttggaatagggcatttccgcacgccgatatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatggggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3802 - protein, 416 aa, Artificial Sequence; identical to SEQ ID NO: 3770
  Description of Artificial Sequence: Synthetic Construct

SEQ ID NO: 3803 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaactgtccgattcgtaaacaagctattcctactaaacgggaactggtacgtgctcctgaagatatggtagacccacttagtgaagatgaagattcgcccgtacccggactgactcatcgttatccggatcgtgtattgttcctcatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacgcacgtgatgaagaggttggtacatttgctggtaaagattcgtgtgcgtccttactatatatatgcttgcgatctttcgcttggaatagggcatttccgcacgccggtatctaagggaatcgaaattatcgaaaatttgcgcggacacaccacgggctatgcggttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccgggggtcagcagttggctttagagcctcccgacttagctcgcaaagaacgcaggagcgataagaactaa

SEQ ID NO: 3804 - protein, 416 aa, Artificial Sequence; identical to SEQ ID NO: 3752
  Description of Artificial Sequence: Synthetic Construct

SEQ ID NO: 3805 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactaaacgggaactggtacgtgctcctgaagatatggtagacccacttagtgaagatgaagattcgcccgtacccggactgactcatcgttatccggatcgtgtattgttcctcatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggtgatgccctccttgtcagcgacgaacgcttggaatacatattgaagcgtctgcgcgaagtacctcatgtggagattgttcgtataggaagccgtgcgccggtagtcctccctcagcgtataacgcctcgattggtggatatgctcaaaaaatatcatccggtgtggctgaacactcacttcaaccacccgaatgaagttaccgaagaagcggtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgatctatgttgtatctcagtccccacgacatgtggttcttcgcaattatgaaggtgttatcacaacctatacggagccggaggactatcatggggagtgcgattgtgaggactgccgagtcgacaagcatcgtgagggcgtggctgcactttccggaggtcagcagttggctttagagcctcccgacttagctcgcaaagaacgcaggagcgataagagctaa

SEQ ID NO: 3806 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPRLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPIYVVSQSPRHVVLRNYEGVITTYTEPEDYHGECDCEDCRVDKHREGVAALSGGQQLALEPPDLARKERRSDKS

SEQ ID NO: 3807 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaggctattcctactaaacgggaactggtacgtgctcctgaagatatggtagacccacttagtgaagatgaagattcgcccgtacccggactgactcatcgttatccggatcgtgtattgttcctcatcacggacaaatgttcgatgtactgtcgtcattgtactcgccgtcgcttcgcaggacagagagacgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggctcttcgcaattatgaaggtgttatcacaacctatacggagccggaggactatcatggggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3808 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVALRNYEGVITTYTEPEDYHGECDCEDCRVDKHREGVAALSGGQQLALEPPDLARKERRSDKN

SEQ ID NO: 3809 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagtcgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggtgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcggtggaggcttgtgaaagaatggccaatgccggtattccgttgggtaaccaaacggttttattgcgtggaatcaatgattgtacgcacgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtggcgccgaactatgttgtatctcagtccccacgacatgtggttcttcgcaattatgaaggtgttatcacaacctatacggagccggaggactatcatggggagtgcgattgtgaggactgccgagccgacaagcatcgtgagggcgtggctgcactttccggaggtcagcagttggctttagagcctcccgacttagctcgcaaagaacgcaggagcgataagaactaa

SEQ ID NO: 3810 - protein, 416 aa, Artificial Sequence
  Description of Artificial Sequence: Synthetic Construct
MAESRRKHYFPDVTDEQWYDWHWQVINRIKSLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHGECDCEDCRADKHREGVAALSGGQQLALEPPDLARKERRSDKN

SEQ ID NO: 3811 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagctattcctactaaacgggaactggtacgtgctcctgaagatatggtagacccacttagtgaagatgaagattcgcccgtacccggactgactcatcgttatccggatcgtgtgttgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgtcgtatctcagtccccacgacatgtggttcttcgcaattatgaaggtgttatcacaacctatacggagccggaggactatcatagggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3812 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHRECDCEDCRVDKHREGVAALSGGQQLALEPPDLARKERRSDKN

SEQ ID NO: 3813 - DNA, 1251 bp, Artificial Sequence
  Description of Artificial Sequence: Synthetic Construct
atggcagaaagtcgtagaaagcattatttccctggtgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacaccacgggctatgcagttcctacctttgtggtacatgctccggggggtggtggtaagatacctgtagcgccgaactatgtcgtatctcagtccccacgacatgtgattcttcgcaattatgaaggtgttatcacaacctatacggagccggaggactatcatggggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3814 - protein, 416 aa, Artificial Sequence
  Description of Artificial Sequence: Synthetic Construct
MAESRRKHYFPGVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTTGYAVPTFVVHAPGGGGKIPVAPNYVVSQSPRHVILRNYEGVITTYTEPEDYHGECDCEDCRVDKHREGVAALSGGQQLALEPPDLARKERRSDKN

SEQ ID NO: 3815 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttcctcatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcgattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacgcatgtgatgaagaggttggtacatttgctggtaaagattcgtgtgcgtccttactacatatatgcttgcgatctttcgcttggaatagggcatttccgcacgccgatatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcggttgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3816 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPRLVDMLKKYHPVWLNTHFNHPNEVTEEAVEACERMANAGIPLGNQTVLLRGINDCTHVMKRLVHLLVKIRVRPYYIYACDLSLGIGHFRTPISKGIEIIENLRGHTSGYAVPTFVVHAPGGGGKIPVAPNYVVSQSPRHVVLRNYEGVITTYTEPEDYHEECGCEDCRVDKHREGVAALSGGQQLALEPPDLARKERRSDKN

SEQ ID NO: 3817 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactaaacgggaactggtacgtgctcctgaagatatggtagacccacttagtgaagatgaagattcgcccgtacccggactgactcatcgttatccggatcgtgtattgttcctcatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcgattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccgatatctaagggaatcgaaattatcgaaaatttgcgcggacacacctcgggctatgctgttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3818 - protein, 416 aa, Artificial Sequence; identical to SEQ ID NO: 3724
  Description of Artificial Sequence: Synthetic Construct

SEQ ID NO: 3819 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaaggatcgcccaaagtactccgaatggctatcacgccttattatttgagtttgatagaccccgagaatcctaactgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcgattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagaggttggtacatttgctggtaaagattcgtgtgcgtccttactacatatatgcttgcgatctttcgcttggaatagggcatttccgcacgccgatatctaagggaatcgaaattatcgaaaatttgcgcggacacacctcgggctatgcggttcctacctttgtggtacatgctccggggggtggtggtaagatacctgtagcgccgaactatgtcgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3820 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKGSPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPRLVDMLKKYHPVWLNTHFNHPNEVTEEAVEACERMANAGIPLGNQTVLLRGINDCTHVMKRLVHLLVKIRVRPYYIYACDLSLGIGHFRTPISKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 3821 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgctgttcctacctttgtggtacatgctccggggggtggtggtaagatacctgtagcgccgaactatgttgtatctcagtccccacgacatgtgattcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagagctaa

SEQ ID NO: 3822 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVILRNYEGVITTYTEPEDYHEECDCEDCRVDKHREGVAALSGGQQLALEPPDLARKERRSDKS

SEQ ID NO: 3823 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaggccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcggtggaggcttgtgaaagaatggccaatgccggtattccgttgggtaaccaaacggttttattgcgtggaatcaatgattgtacgcatgtgatgaagaggttggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtggcgccgaactatgttgtatctcagtccccacgacatgtggttcttcgcaattatgaaggtgttatcacaacctatacggagccggaggactatcatggggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3824 - protein, 416 aa, Artificial Sequence; identical to SEQ ID NO: 3270
  Description of Artificial Sequence: Synthetic Construct

SEQ ID NO: 3825 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaactgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggtgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacgcatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacaccacgggctatgcggttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatggggagtgcgattgtgaggactgccgagccgacaagcatcgtgagggcgtggctgcactttccggaggtcagcagttggctttagagcctcccgacttagctcgcaaagaacgcaggagcgataagaactaa

SEQ ID NO: 3826 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTTGYAVPTFVVHAPGGGGKIPVAPNYVVSQSPRHVVLRNYEGVITTYTEPEDYHGECDCEDCRADKHREGVAALSGGQQLALEPPDLARKERRSDKN

SEQ ID NO: 3827 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaggctattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgccgcttcgcaggacagagagacgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcggtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtggcgccgaactatgtcgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3828 - protein, 416 aa, Artificial Sequence; identical to SEQ ID NO: 3260
  Description of Artificial Sequence: Synthetic Construct

SEQ ID NO: 3829 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaactgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgccgcttcgcgggacagagagacgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcgattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacaccacgggctatgcagttcctacctttgtggtacatgctccggggggtggtggtaagatacctgtagcgccgaactatgtcgtatctcagtccccacgacatgtggttcttcgcaattatgaaggtgttatcacaacctatacggagccggaggactatcatgaggagtgcgattgtgaggactgccgagccgacaagcatcgtgagggcgtggctgcactttccggaggtcagcagttggctttagagcctcccgacttagctcgcaaagaacgcaggagcgataagaactaa

SEQ ID NO: 3830 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPRLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTTGYAVPTFVVHAPGGGGKIPVAPNYVVSQSPRHVVLRNYEGVITTYTEPEDYHEECDCEDCRADKHREGVAALSGGQQLALEPPDLARKERRSDKN

SEQ ID NO: 3831 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtggcgccgaactatgttgtatctcagtccccacgacatgtgattcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3832 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVILRNYEGVITTYTEPEDYHEECDCEDCRVDKHREGVAALSGGQQLALEPPDLARKERRSDKN

SEQ ID NO: 3833 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagacgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcgattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgtcgtatctcagtccccacgacatgtggttcttcgcaattatgaaggtgttatcacaacctatacggagccggaggactatcatggggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3834 - protein, 416 aa, Artificial Sequence; identical to SEQ ID NO: 3702
  Description of Artificial Sequence: Synthetic Construct

SEQ ID NO: 3835 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactaaacgggaactggtacgtgctcttgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcgattggtggatatgctcaaaaaatatcatccggtgtggctgaacactcacttcaaccacccgaatgaagttaccgaagaagcggtggaggcttgtgaaagaatggccaatgccggtattccgttgggtaaccaaacggttttattgcgtggaatcaatgattgtacgcatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatggggagtgcgattgtgaggactgccgagccgacaagcatcgtgagggcgtggctgcactttccggaggtcagcagttggctttagagcctcccgacttagctcgcaaagaacgcaggagcgataagaactaa

SEQ ID NO: 3836 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRALEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPRLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHGECDCEDCRADKHREGVAALSGGQQLALEPPDLARKERRSDKN

SEQ ID NO: 3837 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaactgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaagaaatatcatccggtgtggctgaacactcacttcaaccacccgaatgaagttaccgaagaagcggtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcggttcctacctttgtggtacatgctccggggggtggtggtaagatacctgtagcgccgtactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3838 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPYYVVSQSPRHVVLRNYEGVITTYTEPEDYHEECDCEDCRVDKHREGVAALSGGQQLALEPPDLARKERRSDKN

SEQ ID NO: 3839 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcggtggaggcttgtgaaagaatggccaatgccggtattccgttgggtaaccaaacggttttattgcgtggaatcaatgattgtacacacgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccaacttagctcgcaaagaacgcaggagcgataagaactaa

SEQ ID NO: 3840 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPNLARKERRSDKN

SEQ ID NO: 3841 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagcaaaagaatcgcccaaagtactccgaatggctatcacaccttattatttgagtttgatagaccccgagaatcctaattgtccgattcgtaaacaagccattcctactaaacgggaactggtacatgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtcccctcgacatgtggttcttcgcaattatgaaggtgttatcacaacctatacggagccggaggactatcatggggagtgcgattgtgaggactgccgagtcgacaagcatcgtgagggcgtggctgcactttccggaggtcagcagttggctttagagcctcccgacttagctcgcaaagaacgcaggcgcgataagaactaa

SEQ ID NO: 3842 - protein, 416 aa, Artificial Sequence
  Description of Artificial Sequence: Synthetic Construct
MAESRRKHYFPDVTDEQWYDWHWQVINRIKTLDQLEKYVTLTAEEEEGAKESPKVLRMAITPYYLSLIDPENPNCPIRKQAIPTKRELVHAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHGECDCEDCRVDKHREGVAALSGGQQLALEPPDLARKERRRDKN

SEQ ID NO: 3843 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttgcactcaccgctgaagaagaagagggagcaaaagaatcgcccaaagtactccgaatggctatcacaccttattatttgagtttgatagaccccgagaatcctaattgtccgattcgtaaacaagccattcctactaaacgggaactggtacatgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgcataacgcctcaattggtggatatgctcaaaaaatatcatccggtgtggctgaacactcacttcaaccacccgaatgaagttaccgaagaagcagtggaggcttgtgaaaggatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgagaatttgcgcggacacacctcgggctatgcagttcctacctttgtggtacatgctccggggggtggtggtaagatacctgtagcgccggactatgtggtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggcgcgataagaactaa

SEQ ID NO: 3844 - protein, 416 aa, Artificial Sequence
  Description of Artificial Sequence: Synthetic Construct
MAESRRKHYFPDVTDEQWYDWHWQVINRIKTLDQLEKYVALTAEEEEGAKESPKVLRMAITPYYLSLIDPENPNCPIRKQAIPTKRELVHAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPDYVVSQSPRHVVLRNYEGVITTYTEPEDYHEECDCEDCRVDKHREGVAALSGGQQLALEPPDLARKERRRDKN

SEQ ID NO: 3845 - DNA, 1251 bp, Artificial Sequence
  Description of Artificial Sequence: Synthetic Construct
atggcagaaagacgtagaaagcattatttccctgatgtcaccgatgagcaatggtacgactggcattggcaggtcatcaatcggattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactaactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaataggacatttccgcacgccggtatctaagggaatcgaaattatcgaaaatttgcgcggacacacctcgggctatgcagttcctacctttgtggtacatgctccggggggtggtggtaagatacctgtagcgccggactatgtggtatctcagtccccacgacatgtggttcttcgcaattatgaaggtgttatcacgacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggcgcgataagaactaa

SEQ ID NO: 3846 - protein, 416 aa, Artificial Sequence
  Description of Artificial Sequence: Synthetic Construct
MAERRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPDYVVSQSPRHVVLRNYEGVITTYTEPEDYHEECDCEDCRVDKHREGVAALSGGQQLALEPPDLARKERRRDKN

SEQ ID NO: 3847 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcggattaagacgctcgaccagctggagaagtacgttacactcaccgctgaagaagaagagggagcaaaagaatcgcccaaagtactccgaatggctatcacaccctattatttgagtttgatagaccccgagaatcctaattgtccgattcgtaaacaagccattcctactaaacgggaactggtacgtgctcctgaagatatggtagacccacttagtgaagatgaagattcgcccgtacccggactaactcatcgttatccggatcgcgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaaggatggccaatgccggtattccgttgggtaaccaaacggttttattgcgtggaatcaatgattgtacacatgtgatgaagcgattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggcgcgataagaactaa

SEQ ID NO: 3848 - protein, 416 aa, Artificial Sequence
  Description of Artificial Sequence: Synthetic Construct
MAESRRKHYFPDVTDEQWYDWHWQVINRIKTLDQLEKYVTLTAEEEEGAKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRRDKN

SEQ ID NO: 3849 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactaactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgagcgcttggaatacatattgaagcgtctgcgcgaagtacctcatgtggagattgttcgtataggaagccgtgcgccggtagtcctccctcagcgtataacgcctcaattggtggatatgctcaaaacatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaataggacatttccgcacgccggtatctaagggaatcgaaattatcgaaaatttgcgcggacacacctcgggctatgcagttcctacctttgtggtacatgctccggggggtggtggtaagatacctgtagcgccgagctatgttgtatctcagtccccacgacatgtggttcttcgcaattatgaaggtgttatcacgacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggcgcgataagaactaa

SEQ ID NO: 3850 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKTYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPSYVVSQSPRHVVLRNYEGVITTYTEPEDYHEECDCEDCRVDKHREGVAALSGGQQLALEPPDLARKERRRDKN

SEQ ID NO: 3851 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgcgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgagcgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttaggtaaccaaacggttttattgcgtggaatcaatgattgtacacatgtgatgaagcgattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacgacctatacggagccggaggactatcatgaggagtgcgattgtgaggactgccgtgtcgacaagcatcgtgagggcgtggctgcactttccggaggtcagcagttggctttagagcctcccgacttagctcgcaaagaacgcaggcgcgataagaactaa

SEQ ID NO: 3852 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRRDKN

SEQ ID NO: 3853 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacggagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgtgtcgacaagcatcgtgagggcgtggctgcactttccggaggtcagcagttggctttagagcctcccgacttagctcgcaaagaacgcaggagcgataagaactaa

SEQ ID NO: 3854 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGRRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 3855 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagcaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtaacgccgaactatgttgtatctcagtccccgcgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3856 - protein, 416 aa, Artificial Sequence
  Description of Artificial Sequence: Synthetic Construct
MAESRRKHYFPDVTDEQWYDWHWQVINRIKTLDQLEKYVTLTAEEEEGAKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRVDKHREGVAALSGGQQLALEPPDLARKERRSDKN

SEQ ID NO: 3857 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcggattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacatgctcctgaagatatggtagacccacttagtgaagatgaagattcgcccgtacccggactgactcatcgttatccggatcgcgtattgttccttatcacggacaaatgttcgatgtactgtcgtcattgtactcgccgtcgcttcgcaggacagagagatgcttcttctccttctgagcgcatcgatcggtgcattgaatatatagccaatacaccgacagtccgcgatgttttgctatcgggaggcgatgccctccttgtcagcgacgaacgcttggaatacatattgaagcgtctgcgcgaagtaccccatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3858 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVHAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 3859 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcggattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgagaactggtacgtgctcctgaagatatggtagacccacttagtgaagatgaagattcgcccgtacccggactaactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaaggatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaataggacatttccgcacgccggtatctaagggaatcgaaattatcgaaaatttgcgcggacacacctcgggctatgcagttcccaccttcgtggtacatgctccggggggtggtggtaagatacctgtagcgccgagctacgttgtatctcagtccccgcgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3860 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPSYVVSQSPRHVVLRNYEGVITTYTEPEDYHEECDCEDCRVDKHREGVAALSGGQQLALEPPDLARKERRSDKN

SEQ ID NO: 3861 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcggattaagacgctcgaccagctggagaagtacgttacactcaccgctgaagaagaagagggagtaaaagaatcgcccaaagtactccgaatggctatcacaccttattatttgagtttgatagaccccgaggatcctaattgtccgattcgtaaacaagccattcctactaaacgagaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacggagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggacatgctcaaaaaatatcatccggtgtggctgaacactcacttcaaccacccgaatgaagttaccgaagaagcagtggaggcttgtgaaagaatggccaatgccggtgttccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccggactatgtggtatctcagtccccgcgacatgtggttcttcgcaattatgaaggtgttatcacgacctatacggagccggaggactatcatgaggagtgcgattgtgaggactgccgtgtcgacaagcatcgtgagggcgtggctgcactttccggaggtcagcagttggctttagagcctcccgacttagctcgcaaagaacgcaggagcgataagaactaa

SEQ ID NO: 3862 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPEDPNCPIRKQAIPTKRELVRAPEDMVDPLSEDEDSPVPGLTHRYPDRVLFLITDKCSMYCRHCTRRRFAGRRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGVPLGNQTVLLRGINDCTHVMKRLVHLLVKIRVRPYYIYACDLSLGIGHFRTPVSKGIEIIENLRGHTSGYAVPTFVVHAPGGGGKIPVAPDYVVSQSPRHVVLRNYEGVITTYTEPEDYHEECDCEDCRVDKHREGVAALSGGQQLALEPPDLARKERRSDKN

SEQ ID NO: 3863 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcggattaagacgctcgaccagctggagaagtacgttgcactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgggtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaaggatggccaatgccggtattccgttgggtaaccaaacggttttattgcgtggaatcaatgattgtacacatgtgatgaagagattggtacatttgctggtaaagattcgtgtgcgtccctactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacgacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3864 - protein, 416 aa, Artificial Sequence
  Description of Artificial Sequence: Synthetic Construct
MAESRRKHYFPDVTDEQWYDWHWQVINRIKTLDQLEKYVALTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIGYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 3865 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaagcgggaactggtacgtgctcctgaagatatggtagacccacttagtgaagatgaagattcgcccgtacccggactaactcatcgttatccggatcgtgtattgttccttatcacggacaaatgttcgatgtactgtcgtcattgtactcgccgtcgcttcgcaggacggagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccctactatatatatgcttgcgatctttcgcttggaatagggcatttccgcacgccggtatctaagggaatcgaaattatcgaaaatttgcgcggacacacctcgggctatgcagttcctacctttgtgatacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgtgtcgacaagcatcgtgagggcgtggctgcactttccggaggtcagcagttggctttagagcctcccgacttagctcgcaaagaacgcaggagcgataagaactaa

SEQ ID NO: 3866 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGRRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVIHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 3867 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgaatatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaaggatggccaatgccggtgttccgttgggtaaccaaacggttttattgcgtggaatcaatgattgtacacatgtgatgaagagattggtacatttgctggtaaagattcgtgtgcgtccctactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccggactatgtggtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3868 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGVPLGNQTVLLRGINDCTHVMKRLVHLLVKIRVRPYYIYACDLSLGIGHFRTPVSKGIEIIENLRGHTSGYAVPTFVVHAPGGGGKIPVAPDYVVSQSPRHVVLRNYEGVITTYTEPEDYHEECDCEDCRVDKHREGVAALSGGQQLALEPPDLARKERRSDKN

SEQ ID NO: 3869 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacggagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaaggatggccaatgccggtattccgttgggtaaccaaacggttttattgcgtggaatcaatgattgtacacatgtgatgaagcgattggtacatttgctggtaaagattcgtgtgcgtccttactatatatatgcttgcgatctttcgcttggaataggacatttccgcacgccggtatctaagggaatcgaaattatcgaaaatttgcgcggacacacctcgggctatgcagttcctacctttgtggtacatgctccggggggtggtggtaagatacctgtagcgccggactatgtggtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3870 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGRRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPDYVVSQSPRHVVLRNYEGVITTYTEPEDYHEECDCEDCRVDKHREGVAALSGGQQLALEPPDLARKERRSDKN

SEQ ID NO: 3871 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgagaactggtacatgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcggtgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaaggatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3872 - protein, 416 aa, Artificial Sequence; identical to SEQ ID NO: 3858
  Description of Artificial Sequence: Synthetic Construct

SEQ ID NO: 3873 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccctattatttgagtttgatagaccccgagaatcctaattgtccgattcgtaaacaagccattcctactaaacgggaactggtacatgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacggagagatgcttcttctccttctgagcgcatcgatcgatgcattgagtatatagccaatacaccgacagtccgcgatgttttgctatcgggaggcgatgccctccttgtcagcgacgagcgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagcgattggtacatctgctggtaaagattcgtgtgcgtccctactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgagctatgttgtatctcagtccccacgacatgtggttcttcgcaattatgaaggtgttatcacgacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3874 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVHAPEDMVDPLSEDEDSPVPGLTHRYPDRVLFLITDKCSMYCRHCTRRRFAGRRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPSYVVSQSPRHVVLRNYEGVITTYTEPEDYHEECDCEDCRVDKHREGVAALSGGQQLALEPPDLARKERRSDKN

SEQ ID NO: 3875 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgaatatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaaaaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgtcatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggcgcgataagaactaa

SEQ ID NO: 3876 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACEKMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRRDKN

SEQ ID NO: 3877 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagcaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgagcgcttggaatacatattgaagcgtctgcgcgaagtacctcacgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaaggatggccaatgccggtgttccgttgggtaaccaaacggttttattgcgtggaatcaatgattgtacacatgtgatgaagcgattggtacatctgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggcgcgataagaactaa

SEQ ID NO: 3878 - protein, 416 aa, Artificial Sequence
  Description of Artificial Sequence: Synthetic Construct
MAESRRKHYFPDVTDEQWYDWHWQVINRIKTLDQLEKYVTLTAEEEEGAKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGVPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRRDKN

SEQ ID NO: 3879 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcggattaagacgctcgaccagctggagaagtacgttacactcaccgctgaagaagaagagggagcaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaaggatggccaatgccggtattccgttgggtaaccaaacggttttattgcgtggaatcaatgattgtacacatgtgatgaagcgattggtacatttgctggtaaagattcgtgtgcgtccctactatatatatgcttgcgatctttcgcttggaataggacatttccgcacgccggtatctaagggaatcgaaattatcgaaaatttgcgcggacacacctcgggctatgcagttcccacctttgtggtacatgctccggggggtggtggtaagatacctgtagcgccgagctatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggcagcactttccggaggtcagcagttggctttagagcctcccgacttagctcgcaaagaacgcaggagcgataagaactaa

SEQ ID NO: 3880 - protein, 416 aa, Artificial Sequence
  Description of Artificial Sequence: Synthetic Construct
MAESRRKHYFPDVTDEQWYDWHWQVINRIKTLDQLEKYVTLTAEEEEGAKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPSYVVSQSPRHVVLRNYEGVITTYTEPEDYHEECDCEDCRVDKHREGVAALSGGQQLALEPPDLARKERRSDKN

SEQ ID NO: 3881 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaaggatggccaatgccggtattccgttgggtaaccaaacggttttattgcgtggaatcaatgattgtacacatgtgatgaagcgattggtacatttgctggtaaagattcgtgtgcgtccctactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgtgtcgacaagcatcgtgagggcgtggctgcactttccggaggtcagcagttggctttagagcctcccgacttagctcgcaaagaacgcaggagcgataagaactaa

SEQ ID NO: 3882 - protein, 416 aa, Artificial Sequence; identical to SEQ ID NO: 3260
  Description of Artificial Sequence: Synthetic Construct

SEQ ID NO: 3883 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcggattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgcgtattgttccttatcacggacaaatgttcgatgtactgtcgtcattgtactcgccgtcgcttcgcaggacagagagatgcttcttctccttctgagcgcatcgatcgatgcattgagtatatcgccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagcgattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggcgcgataagaactaa

SEQ ID NO: 3884 - protein, 416 aa, Artificial Sequence; identical to SEQ ID NO: 3852
  Description of Artificial Sequence: Synthetic Construct

SEQ ID NO: 3885 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtgttccgttgggtaaccaaacggttttattgcgtggaatcaatgattgtacacatgtgatgaagagattggtacatttgctggtaaagattcgtgtgcgtccctactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgtggtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggcgcgataagaactaa

SEQ ID NO: 3886 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGVPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRRDKN

SEQ ID NO: 3887 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccctattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcggtgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatctgctggtaaagattcgtgtgcgtccctactatatatatgcttgcgatctttcgcttggaatagggcatttccgcacgccggtatctaggggaatcgaaattatcgaaaatttgcgcggacacacctcgggctatgcagttcctaccttcgtggtacatgctccggggggtggtggtaagatacctgtagcgccgaactatgttgtatctcagtccccacgacatgtggttcttcgcaattatgaaggtgttatcacgacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggcgcgataagaactaa

SEQ ID NO: 3888 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSRGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRRDKN

SEQ ID NO: 3889 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcggattaagacgctcgaccagctggagaagtacgttacactcaccgctgaagaagaagagggagtaaaagaatcgcccaaagtactccgaatggctatcacacctcattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccctactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3890 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPHYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 3891 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcggattaagacgctcgaccagctggagaagtacgttacactcaccgctgaagaagaagagggagtaaaagaatcgcccaaagtactccgaatggctatcacaccctattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtgttccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccggactatgtggtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3892 - protein, 416 aa, Artificial Sequence; identical to SEQ ID NO: 3868
  Description of Artificial Sequence: Synthetic Construct

SEQ ID NO: 3893 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagcaaaagaatcgcccaaagtactccgaatggctatcacaccctattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgaatatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtagccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacgacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggcgcgataagaactaa

SEQ ID NO: 3894 - protein, 416 aa, Artificial Sequence
  Description of Artificial Sequence: Synthetic Construct
MAESRRKHYFPDVTDEQWYDWHWQVINRIKTLDQLEKYVTLTAEEEEGAKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGSQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRRDKN

SEQ ID NO: 3895 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttgcactcaccgctgaagaagaagagggagtaaaagaatcgcccaaagtactccgaatggctatcacaccctattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgcgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaaggatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcccacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3896 - protein, 416 aa, Artificial Sequence
  Description of Artificial Sequence: Synthetic Construct
MAESRRKHYFPDVTDEQWYDWHWQVINRIKTLDQLEKYVALTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 3897 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtgcgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgagaactggtacgtgctcctgaagatatggtagacccacttagtgaagatgaagattcgcccgtacccggactgactcatcgttatccggatcgcgtattgttccttatcacggacaaatgttcgatgtactgtcgtcattgtactcgccgtcgcttcgcaggacggagagatgcttcttctccttctgagcgcatcgatcgatgcattgagtatatagccaatacaccgacagtccgcgatgttttgctatcgggaggcgatgccctccttgtcagcgacgagcgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaaggatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccgcgtcatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggcgcgataagaactaa

SEQ ID NO: 3898 - protein, 416 aa, Artificial Sequence
  Description of Artificial Sequence: Synthetic Construct
MAESRRKHYFPDVTDEQWYDWHWQVINRIKTLDQLEKCVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGRRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRRDKN

SEQ ID NO: 3899 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcggattaagacgctcgaccagctggagaagtacgttacactcaccgctgaagaagaagagggagcaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaatgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaaggatggccaatgccggtgttccgttgggtaaccaaacggttttattgcgtggaatcaatgattgtacacatgtgatgaagagattggtacatttgctggtaaagagtcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgtggtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3900 - protein, 416 aa, Artificial Sequence
  Description of Artificial Sequence: Synthetic Construct
MAESRRKHYFPDVTDEQWYDWHWQVINRIKTLDQLEKYVTLTAEEEEGAKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDECLEYILKRLREVPHVEIVRIGSRAPVVLPQRITPQLVDMLKKYHPVWLNTHFNHPNEVTEEAVEACERMANAGVPLGNQTVLLRGINDCTHVMKRLVHLLVKSRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 3901 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacggagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtgttccgttgggtaaccaaacggttttattgcgtggaatcaatgattgtacacatgtgatgaagagattggtacatttgctggtaaagattcgtgtgcgtccttactatatatatgcttgcgatctttcgcttggaataggacatttccgcacgccggtatctaagggaatcgaaattatcgaaaatttgcgcggacacacctcgggctatgcagttcctaccttcgtggtacatgctccggggggtggtggtaagatacctgtagcgccggactatgtggtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggcgcgataagaactaa

SEQ ID NO: 3902 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGRRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGVPLGNQTVLLRGINDCTHVMKRLVHLLVKIRVRPYYIYACDLSLGIGHFRTPVSKGIEIIENLRGHTSGYAVPTFVVHAPGGGGKIPVAPDYVVSQSPRHVVLRNYEGVITTYTEPEDYHEECDCEDCRVDKHREGVAALSGGQQLALEPPDLARKERRRDKN

SEQ ID NO: 3903 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctaccaaacgggaactggtacgtgctcctgaagatatggtagacccacttagtgaagatgaagattcgcccgtacccggactgactcatcgttatccggatcgcgtattgttccttatcacggacaaatgttcgatgtactgtcgtcattgtactcgccgtcgcttcgcaggacggagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaaggatggccaatgccggtattccgttgggtaaccaaacggttttattgcgtggaatcaatgactgtacacatgtgatgaagagattggtacatttgctggtaaagattcgtgtgcgtccctactatatatatgcttgcgatctttcgcttggaatagggcatttccgcacgccggtatctaagggaatcgaaattatcgaaaatttgcgcggacacacctcgggctatgcagttcccaccttcgtggtacatgctccggggggtggtggtaagatacctgtagcgccgaactatgttgtatctcagtccccacgacatgtggctcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggcgcgataagaactaa

SEQ ID NO: 3904 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGRRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVALRNYEGVITTYTEPEDYHEECDCEDCRVDKHREGVAALSGGQQLALEPPDLARKERRRDKN

SEQ ID NO: 3905 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagcaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactaactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggtcttattgcgtggaatcaatgattgtacacatgtgatgaagcgattggtacatttgctggtaaagattcgtgtgcgtccctactatatatatgcttgcgatctttcgcttggaatagggcatttccgcacgccggtatctaagggaatcgaaattatcgaaaatttgcgcggacacacctcgggctatgcagttcctaccttcgtggtacatgctccggggggtggtggtaagatacctgtagcaccgaactatgttgtatctcagtccccgcgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggcgcgataagaactaa

SEQ ID NO: 3906 - protein, 416 aa, Artificial Sequence; identical to SEQ ID NO: 3848
  Description of Artificial Sequence: Synthetic Construct

SEQ ID NO: 3907 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcggattaagacgctcgaccagctggagaagtacgttacactcaccgctgaagaagaagagggagtaaaagaatcgcccaaagtactccgaatggctatcacaccctattatttgagtttgatagaccccgagaatcctaattgtccgattcgtaaacaagccattcctactaaacgggaactggtacgtgctcctgaagatatggtagacccacttagtgaagatgaagattcgcccgtacccggactaactcatcgttatccggatcgcgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaaggatggccaatgccggtattccgttgggtaaccaaacggttttattgcgtggaatcaatgattgtacacatgtgatgaagcgattggtacatctgctggtaaagattcgtgtgcgtccctactatatatatgcttgcgatctttcgcttggaataggacatttccgcacgccggtatctaagggaatcgaaattatcgaaaatttgcgcggacacacctcgggctatgcagttcctacctttgtggtacatgctccggggggtggtggtaagatacctgtagcgccgagctatgttgtatctcagtccccacgacatgtggttcttcgcaattatgaaggtgttatcacaacctatacggagccggaggactatcatgaggagtgcgattgtgaggactgccgtgtcgacaagcatcgtgagggcgtggctgcactttccggaggtcagcagttggctttagagcctcccgacttagctcgcaaagaacgcaggcgcgataagaactaa

SEQ ID NO: 3908 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPSYVVSQSPRHVVLRNYEGVITTYTEPEDYHEECDCEDCRVDKHREGVAALSGGQQLALEPPDLARKERRRDKN

SEQ ID NO: 3909 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgcgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaaggatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgtgtcgacaagcatcgtgagggcgtggctgcactttccggaggtcagcagttggctttagagcctcccgacttagctcgcaaagaacgcaggcgcgataagaactaa

SEQ ID NO: 3910 - protein, 416 aa, Artificial Sequence; identical to SEQ ID NO: 3852
  Description of Artificial Sequence: Synthetic Construct

SEQ ID NO: 3911 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactaactcatcgttatccggatcgtgtattgttccttatcacggacaaatgttcgatgtactgtcgtcattgtactcgccgtcgcttcgcaggacggagagatgcttcttctccttctgagcgcatcgatcgatgcattgagtatatagccaatacaccgacagtccgcgatgttttgctatcgggaggcgatgccctccttgtcagcgacgagcgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaataggacatttccgcacgccggtatctaagggaatcgaaattatcgaaaatttgcgcggacacacctcgggctatgcagttcctacctttgtggtacatgctccggggggtggtggtaagatacctgtagcgccggactatgtggtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3912 - protein, 416 aa, Artificial Sequence; identical to SEQ ID NO: 3870
  Description of Artificial Sequence: Synthetic Construct

SEQ ID NO: 3913 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcggattaagacgctcgaccagctggagaagtacgttacactcaccgctgaagaagaagagggagtaaaagaatcgcccaaagtactccgaatggctatcacaccctattatttgagtttgatagaccccgagaatcctaattgtccgattcgtaaacaagccattcctactaaacgagaactggtacgtgctcctgaagatatggtagacccacttagtgaagatgaagattcgcccgtacccggactaactcatcgttatccggatcgtgtattgttccttatcacggacaaatgttcggtgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtcccctcgacatgtggttcttcgcaattatgaaggtgttatcacgacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggcgcgataagaactaa

SEQ ID NO: 3914 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSVYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRRDKN

SEQ ID NO: 3915 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcggattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactaactcatcgttatccggatcgtgtattgttccttatcacggacaaatgttcgatgtactgtcgtcattgtactcgccgtcgcttcgcaggacggagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtgttccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3916 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGRRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGVPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 3917 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgagtggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacggagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctaccttcgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3918 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRVAITPYYLSLIDPENPNCPIRKQAIPTKRELVRAPEDMVDPLSEDEDSPVPGLTHRYPDRVLFLITDKCSMYCRHCTRRRFAGRRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 3919 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagcaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctaccttcgtggtacatgctccggggggtggtggtaagatacctgtagcgccgaactatgttgtatctcagtccccacgacatgtggttcttcgcaattatgaaggtgttatcacgacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3920 - protein, 416 aa, Artificial Sequence
  Description of Artificial Sequence: Synthetic Construct
MAESRRKHYFPDVTDEQWYDWHWQVINRIKTLDQLEKYVTLTAEEEEGAKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 3921 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcggattaagacgctcgaccagctggagaaatacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggaggttgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccctactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccggactatgtggtatctcagtccccacgacatgtggttcttcgcaattatgaaggtgttatcacgacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3922 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEVVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPDYVVSQSPRHVVLRNYEGVITTYTEPEDYHEECDCEDCRVDKHREGVAALSGGQQLALEPPDLARKERRSDKN

SEQ ID NO: 3923 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactaactcatcgttatccggatcgcgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaaggatggccaatgccggtattccgttgggtaaccaaacggttttattgcgtggaatcaatgattgtacacatgtgatgaagagattggtacatttgctggtaaagattcgtgtgcgtccctactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccggactatatggtatctcagtccccacgacatgtggttcttcgcaattatgaaggtgttatcacaacctatacggagccggaggactatcatgaggagtgcgattgtgaggactgccgtgtcgacaagcatcgtgagggcgtggctgcactttccggaggtcagcagttggctttagagcctcccgacttagctcgcaaagaacgcaggagcgataagaactaa

SEQ ID NO: 3924 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPDYMVSQSPRHVVLRNYEGVITTYTEPEDYHEECDCEDCRVDKHREGVAALSGGQQLALEPPDLARKERRSDKN

SEQ ID NO: 3925 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagcaaaagaatcgcccaaagtactccgaatggctatcacaccttattatttgagtttgatagaccccgagaatcctaattgtccgattcgtaaacaagccattcctactaaacgagaactggtacgtgctcctgaagatatggtagacccacttagtgaagatgaagattcgcccgtacccggactgactcatcgttatccggatcgtgtattgttcctcatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtgttccgttgggtaaccaaacggttttattgcgtggaatcaatgattgtacacatgtgatgaagagattggtacatctgctggtaaagattcgtgtgcgtccctactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccgcgtcatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3926 - protein, 416 aa, Artificial Sequence
  Description of Artificial Sequence: Synthetic Construct
MAESRRKHYFPDVTDEQWYDWHWQVINRIKTLDQLEKYVTLTAEEEEGAKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGVPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 3927 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcggattaagacgctcgaccagctggagaagtacgttacactcaccgctgaagaagaagagggagcaaaagaatcgcccaaagtactccgaatggctatcacaccctattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgcgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccctactatatatatgcttgcgatctttcgcttggaataggacatttccgcacgccggtatctaagggaatcgaaattatcgaaaatttgcgcggacacacctcgggctatgcagttcctaccttcgtggtacatgctccggggggtggtggtaagatacctgtagcgccggactatgttgtatctcagtccccacgacatgtggttcttcgcaattatgaaggtgttatcacaacctatacggagccggaggactatcatgaggagtgcgattgtgaggactgccgtgtcgacaagcatcgtgagggcgtggctgcactttccggaggtcagcagttggctttagagcctcccgacttagctcgcaaagaacgcaggagcgataagaactaa

SEQ ID NO: 3928 - protein, 416 aa, Artificial Sequence
  Description of Artificial Sequence: Synthetic Construct
MAESRRKHYFPDVTDEQWYDWHWQVINRIKTLDQLEKYVTLTAEEEEGAKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPDYVVSQSPRHVVLRNYEGVITTYTEPEDYHEECDCEDCRVDKHREGVAALSGGQQLALEPPDLARKERRSDKN

SEQ ID NO: 3929 - DNA, 1251 bp, Artificial Sequence
  Description of Artificial Sequence: Synthetic Construct
atggcagaaagtcgtagaaagcattatttccctgatgtcaccaatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccctactatatatatgcttgcgatctttcgcttggaataggacatttccgcacgccggtatctaagggaatcgaaattatcgaaaatttgcgcggacacacctcgggctatgcagttcctacctttgtggtacatgctccggggggtggtggtaagatacctgtagcgccggactatgtggtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3930 - protein, 416 aa, Artificial Sequence
  Description of Artificial Sequence: Synthetic Construct
MAESRRKHYFPDVTNEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPDYVVSQSPRHVVLRNYEGVITTYTEPEDYHEECDCEDCRVDKHREGVAALSGGQQLALEPPDLARKERRSDKN

SEQ ID NO: 3931 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttgcactcaccgctgaagaagaagagggagcaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgcgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgagcgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtgttccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgagattatcgaaaatttgcgcggacacacctcgggctatgcagttcctacctttgtggtacatgctccggggggtggtggtaagatacctgtagcgccgaactatgtggtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3932 - protein, 416 aa, Artificial Sequence
  Description of Artificial Sequence: Synthetic Construct
MAESRRKHYFPDVTDEQWYDWHWQVINRIKTLDQLEKYVALTAEEEEGAKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGVPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 3933 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgcgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccctactatatatatgcttgcgatctttcgcttggaataggacatttccgcacgccggtatctaagggaatcgaaattatcgaaaatttgcgcggacacacctcgggctatgcagttcccacctttgtggtacatgctccggggggtggtggtaagatacctgtagcgccgaactatgtggtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggcgcgataagaactaa

SEQ ID NO: 3934 - protein, 416 aa, Artificial Sequence; identical to SEQ ID NO: 3852
  Description of Artificial Sequence: Synthetic Construct

SEQ ID NO: 3935 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcggattaagacgctcgaccagctggagaagtacgttgcactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgcgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaaggatggccaatgccggtattccgttgggtaaccaaacggttttattgcgtggaatcaatgattgtacacatgtgatgaagagattggtacatttgctggtaaagattcgtgtgcgtccctactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgtcatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggcgcgataagaactaa

SEQ ID NO: 3936 - protein, 416 aa, Artificial Sequence
  Description of Artificial Sequence: Synthetic Construct
MAESRRKHYFPDVTDEQWYDWHWQVINRIKTLDQLEKYVALTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRRDKN

SEQ ID NO: 3937 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcggattaagacgctcgaccagctggagaagtacgttgcactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggaacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaaggatggccaatgccggtgttccgttgggtaaccaaacggttttattgcgtggaatcaatgattgtacacatgtgatgaagagattggtacattcgctggtaaagattcgtgtgcgtccttactatatatatgcttgcgatctttcgcttggaataggacatttccgcacgccggtatctaagggaatcgaaattatcgaaaatttgcgcggacacacctcgggctatgcagttcctacctttgtggtacatgctccggggggtggtggtaagatacctgtagcgccgaactatgtggtatctcagtccccacgacatgtggttcttcgcaattatgaaggtgttatcacgacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggcgcgataagaactaa

SEQ ID NO: 3938 - protein, 416 aa, Artificial Sequence
  Description of Artificial Sequence: Synthetic Construct
MAESRRKHYFPDVTDEQWYDWHWQVINRIKTLDQLEKYVALTAEEEEGVKESPKVLRMAITPYYLSLIDPENPNCPIRKQAIPTKRELERAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGVPLGNQTVLLRGINDCTHVMKRLVHSLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRRDKN

SEQ ID NO: 3939 - DNA, 1251 bp, Artificial Sequence
  Description of Artificial Sequence: Synthetic Construct
atgacagaaagtcgtagaaagcattatttccctgatgtcaccgatgagcaatggtacgactggcattggcaggtcatcaatcggattaagacgctcgaccagctggagaagtacgttacactcaccgctgaagaggaagagggagtaaaagaatcgcccaaagtactccgaatggctatcacaccctattatttgagtttgatagaccccgagaatcctaattgtccgattcgtaaacaagccattcctactaaacgggaactggtacgtgctcctgaagatatggtagacccacttagtgaagatgaagattcgcccgtacccggactaactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgaatatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaactctcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaataggacatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3940 - protein, 416 aa, Artificial Sequence
  Description of Artificial Sequence: Synthetic Construct
MTESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNSHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 3941 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagcaaaagaatcgcccaaagtattccgaatggctatcacaccctattatttgagtttgatagaccccgagaatcctaattgtccgattcgtaaacaagccattcctactaaacgggaactggtacgtgctcctgaagatatggtagacccacttagtgaagatgaagattcgcccgtacccggactaactcatcgttatccggatcgtgtattgttccttatcacggacaaatgttcgatgtactgtcgtcattgtactcgccgtcgcttcgcaggacggagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtttgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacgacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3942 - protein, 416 aa, Artificial Sequence
  Description of Artificial Sequence: Synthetic Construct
MAESRRKHYFPDVTDEQWYDWHWQVINRIKTLDQLEKYVTLTAEEEEGAKESPKVFRMAITPYYLSLIDPENPNCPIRKQAIPTKRELVRAPEDMVDPLSEDEDSPVPGLTHRYPDRVLFLITDKCSMYCRHCTRRRFAGRRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 3943 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccctattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacggagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccctactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgtggtatctcagtccccacgacatgtggttcttcgcaattatgaaggtgttatcacaacctatacggagccggaggactatcatgaggagtgcgattgtgaggactgccgtgtcgacaagcatcgtgagggcgtggctgcactttccggaggtcagcagttggctttagagcctcccgacttagctcgcaaagaacgcaggagcgataagaactaa

SEQ ID NO: 3944 - protein, 416 aa, Artificial Sequence; identical to SEQ ID NO: 3854
  Description of Artificial Sequence: Synthetic Construct

SEQ ID NO: 3945 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactaactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgagcgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtgttccgttgggtaaccaaacggttttattgcgtggaatcaatgattgtacacatgtgatgaagagattggtacatttgctggtaaagattcgtgtgcgtccctactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccgcgtcatgtggttcttcgcaattatgaaggtgttatcacgacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3946 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGVPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 3947 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccctattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagcgattggtacatttgctggtaaagattcgtgtgcgtccttactatatatatgcttgcgatctttcgcttggaataggacatttccgcacgccggtatctaagggaatcgaaattatcgaaaatttgcgcggacacacctcgggctatgcagttcccacctttgtggtacatgctccggggggtggtggtaagatacctgtagcgccgaactatgttgtatctcagtccccgcgacatgtggttcttcgcaattatgaaggtgttatcacaacctatacggagccggaggactatcatgaggagcgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3948 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEERDCEDCRVDKHREGVAALSGGQQLALEPPDLARKERRSDKN

SEQ ID NO: 3949 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccctattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgcgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaaggatggccaatgccggtgttccgttgggtaaccaaacggttttattgcgtggaatcaatgattgtacacatgtgatgaagagattggtacatttgctggtaaagattcgtgtgcgtccttactatatatatgcttgcgatctttcgcttggaataggacatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3950 - protein, 416 aa, Artificial Sequence; identical to SEQ ID NO: 3946
  Description of Artificial Sequence: Synthetic Construct

SEQ ID NO: 3951 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactaactcatcgttatccggatcgtgtattgttccttatcacggacaaatgttcgatgtactgtcgtcattgtactcgccgtcgcttcgcaggacagagagatgcttcttctccttccgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaaggatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcccaccttcgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggcgcgataagaactaa

SEQ ID NO: 3952 - protein, 416 aa, Artificial Sequence; identical to SEQ ID NO: 3852
  Description of Artificial Sequence: Synthetic Construct

SEQ ID NO: 3953 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcggattaagacgctcgaccagctggagaagtacgttacactcaccgctgaagaagaagagggagcaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacggagagatgcttcttctccttctgagcgcatcgatcgatgcattgagtatatagccaatacaccgacagtccgcgatgttttgctatcgggaggcgatgccctccttgtcagcgacgagcgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgtgtcgacaagcatcgtgagggcgtggctgcactttccggaggtcagcagttggctttagagcctcccgacttagctcgcaaagaacgcaggcgcgataagaactaa

SEQ ID NO: 3954 - protein, 416 aa, Artificial Sequence
  Description of Artificial Sequence: Synthetic Construct
MAESRRKHYFPDVTDEQWYDWHWQVINRIKTLDQLEKYVTLTAEEEEGAKESPKVLRMAITPYYLSLIDPENPNCPIRKQAIPTKRELVRAPEDMVDPLSEDEDSPVPGLTHRYPDRVLFLITDKCSMYCRHCTRRRFAGRRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRRDKN

SEQ ID NO: 3955 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcggattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcggtgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaaggatggccaatgccggtattccgttgggtaaccaaacggttttattgcgtggaatcaatgattgtacacatgtgatgaagcgattggtacatctgctggtaaagattcgtgtgcgtccctactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgtgtcgacaagcatcgtgagggcgtggctgcactttccggaggtcagcagttggctttagagcctcccgacttagctcgcaaagaacgcaggagcgataagaactaa

SEQ ID NO: 3956 - protein, 416 aa, Artificial Sequence; identical to SEQ ID NO: 3260
  Description of Artificial Sequence: Synthetic Construct

SEQ ID NO: 3957 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcggattaagacgctcgaccagctggagaagtacgttgcactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagataccggtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3958 - protein, 416 aa, Artificial Sequence; identical to SEQ ID NO: 3896
  Description of Artificial Sequence: Synthetic Construct

SEQ ID NO: 3959 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcggattaagacgctcgaccagctggagaagtacgttgcactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgcgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaaggatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacgacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3960 - protein, 416 aa, Artificial Sequence; identical to SEQ ID NO: 3896
  Description of Artificial Sequence: Synthetic Construct

SEQ ID NO: 3961 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcggattaagacgctcgaccagctggagaagtacgttacactcaccgctgaagaagaagagggagtaaaagaatcgcccaaagtactccgaatggctatcacaccctattatttgagtttgatagaccccgagaatcctaattgtccgattcgtaaacaagccattcctactaaacgagaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgaatatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaaggatggccaatgccggtattccgttgggtaaccaaacggttttattgcgtggaatcaatgattgtacacatgtgatgaagagattggtacatctgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgtggtatctcagtccccacgacatgtggttcttcgcaattatgaaggtgttatcacaacctatacggagccggaggactatcatgaggagtgcgattgtgaggactgccgtgtcgacaagcatcgtgagggcgtggctgcactttccggaggtcagcagttggctttagagcctcccgacttagctcgcaaagaacgcaggcgcgataagaactaa

SEQ ID NO: 3962 - protein, 416 aa, Artificial Sequence; identical to SEQ ID NO: 3852
  Description of Artificial Sequence: Synthetic Construct

SEQ ID NO: 3963 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagcaaaagaatcgcccaaagtactccgaatggctatcacaccttattatttgagtttgatagaccccgagaatcctaattgtccgattcgtaaacaagccattcctactatacgggaactggtacgtgctcctgaagatatggtagacccacttagtgaagatgaagattcgcccgtacccggactaactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaaggatggccaatgccggtattccgttgggtaaccaaacggttttattgcgtggaatcaatgattgtacacatgtgatgaagagattggtacatttgctggtaaagattcgtgtgcgtccctactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgtgtcgacaagcatcgtcagggcgtggctgcactttccggaggtcagcagttggctttagagcctcccgacttagctcgcaaagaacgcaggcgcgataagaactaa

SEQ ID NO: 3964 - protein, 416 aa, Artificial Sequence
  Description of Artificial Sequence: Synthetic Construct
MAESRRKHYFPDVTDEQWYDWHWQVINRIKTLDQLEKYVTLTAEEEEGAKESPKVLRMAITPYYLSLIDPENPNCPIRKQAIPTIRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHRQGVAALSGGQQLALEPPDLARKERRRDKN

SEQ ID NO: 3965 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcggattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgaccgtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaaggatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3966 - protein, 416 aa, Artificial Sequence; identical to SEQ ID NO: 3260
  Description of Artificial Sequence: Synthetic Construct

SEQ ID NO: 3967 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcggattaagacgctcgaccagctggagaagtacgttgcactcaccgctgaagaagaagagggagtaaaagaatcgcccaaagtactccgaatggctatcacaccctattatttgagtttgatagaccccgagaatcctaattgtccgattcgtaaacaagccattcctactaaacgggaactggtacgtgctcctgaagatatggtagacccacttagtgaagatgaagattcgcccgtacccggactaactcatcgttatccggatcgcgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccctactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggcgcgataagaactaa

SEQ ID NO: 3968 - protein, 416 aa, Artificial Sequence; identical to SEQ ID NO: 3936
  Description of Artificial Sequence: Synthetic Construct

SEQ ID NO: 3969 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcggattaagacgctcgaccagctggagaagtacgttgcactcaccgctgaagaagaagagggagtaaaagaatcgcccaaagtactccgaatggctatcacaccctattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgcgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccctactatatatatgcttgcgatctttcgcttggaataggacatttccgcacgccggtatctaagggaatcgaaattatcgaaaatttgcgcggacacacctcgggctatgcagttcctacctttgtggtacatgctccggggggtggtggtaagatacctgtagcgccggactatgttgtatctcagtccccacgacatgtggttcttcgcaattatgaaggtgttatcacaacctatacggagccggaggactatcatgaggagtgcgattgtgaggactgccgtgtcgacaagcatcgtgagggcgtggctgcactttccggaggtcagcagttggctttagagcctcccgacttagctcgcaaagaacgcaggcgcgataagaactaa

SEQ ID NO: 3970 - protein, 416 aa, Artificial Sequence
  Description of Artificial Sequence: Synthetic Construct
MAESRRKHYFPDVTDEQWYDWHWQVINRIKTLDQLEKYVALTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPDYVVSQSPRHVVLRNYEGVITTYTEPEDYHEECDCEDCRVDKHREGVAALSGGQQLALEPPDLARKERRRDKN

SEQ ID NO: 3971 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcggattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactaactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaaggatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaataggacatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgtcatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3972 - protein, 416 aa, Artificial Sequence; identical to SEQ ID NO: 3260
  Description of Artificial Sequence: Synthetic Construct

SEQ ID NO: 3973 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttgcactcaccgctgaagaagaagagggagtaaaagaatcgcccaaagtactccgaatggctatcacaccctattatttgagtttgatagaccccgagaatcctaattgtccgattcgtaaacaagccattcctactaaacgggaactggtacatgctcctgaagatatggtagacccacttagtgaagatgaagattcgcccgtacccggactgactcatcgttatccggatcgcgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggagtcaatgattgtacacatgtgatgaagagattggtacatttgctggtaaagattcgtgtgcgtccctactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccgcgtcatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3974 - protein, 416 aa, Artificial Sequence
  Description of Artificial Sequence: Synthetic Construct
MAESRRKHYFPDVTDEQWYDWHWQVINRIKTLDQLEKYVALTAEEEEGVKESPKVLRMAITPYYLSLIDPENPNCPIRKQAIPTKRELVHAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGVNDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 3975 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcggattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactaactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaaggatggccaatgccggtattccgttgggtaaccaaacggttttattgcgtggaatcaatgattgtacacatgtgatgaagcgattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3976 - protein, 416 aa, Artificial Sequence; identical to SEQ ID NO: 3260
  Description of Artificial Sequence: Synthetic Construct

SEQ ID NO: 3977 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttgcactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgcgtattgttccttatcacggacaaatgttcgatgtactgtcgtcattgtactcgccgtcgcttcgcaggacagggagatgcttcttctccttctgagcgcatcgatcggtgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaagatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgtcgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggcgcgataagaactaa

SEQ ID NO: 3978 - protein, 416 aa, Artificial Sequence
  Description of Artificial Sequence: Synthetic Construct
MAESRRKHYFPDVTDEQWYDWHWQVINRIKTLDQLEKYVALTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQGDASSPSERIDRCIEYIANTPTVRDVLLSGGDALLVSDERLEYILKRLREVPHVEIVRIGSRAPVVLPQRITPQLVDMLKRYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRRDKN

SEQ ID NO: 3979 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaaggatggccaatgccggtattccgttgggtaaccaaacggttttattgcgtggaatcaatgattgtacacatgtgatgaagagattggtacatttgctggtaaagattcgtgtgcgtccctactatatatatgcttgcgatctttcgcttggaatagggcatttccgcacgccggtatctaagggaatcgaaattatcgaaaatttgcgcggacacacctcgggctatgcagttcccacctttgtggtacatgctccggggggtggtggtaagatacctgtagcgccgaactatgttgtatctcagtccccacgacatgtggttcttcgcaattatgaaggtgttatcacgacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3980 - protein, 416 aa, Artificial Sequence; identical to SEQ ID NO: 3260
  Description of Artificial Sequence: Synthetic Construct

SEQ ID NO: 3981 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaggacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgagaactggtacatgctcctgaagatatggtagacccacttagtgaagatgaagattcgcccgtacccggactgactcatcgttatccggatcgcgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccctactatatatatgcttgcgatctttcgcttggaatagggcatttccgcacgccggtatctaagggaatcgaaattatcgaaaatttgcgcggacacacctcgggctatgcagttcccacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggcgcgataagaactaa

SEQ ID NO: 3982 - protein, 416 aa, Artificial Sequence
  Description of Artificial Sequence: Synthetic Construct
MAESRRKHYFPDVTDEQWYDWHWQVINRIRTLDQLEKYVTLTAEEEEGVKESPKVLRMAITPYYLSLIDPENPNCPIRKQAIPTKRELVHAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRRDKN

SEQ ID NO: 3983 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactaactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaaggatggccaatgccggtattccgttgggtaaccaaacggttttattgcgtggaatcaatgattgtacacatgtgatgaagagattggtacatttactggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgtgtcgacaagcatcgtgagggcgtggctgcactttccggaggtcagcagttggctttagagcctcccgacttagctcgcaaagaacgcaggagcgataagaactaa

SEQ ID NO: 3984 - protein, 416 aa, Artificial Sequence; identical to SEQ ID NO: 3260
  Description of Artificial Sequence: Synthetic Construct

SEQ ID NO: 3985 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactaactcatcgttatccggatcgtgtattgttccttatcacggacaaatgttcgatgtactgtcgtcattgtactcgccgtcgcttcgcaggacagagagatgcttcttctccttctgagcgcatcgatcggtgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatctgctggtaaagattcgtgtgcgtccctactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccggactatgtggtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3986 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPDYVVSQSPRHVVLRNYEGVITTYTEPEDYHEECDCEDCRVDKHREGVAALSGGQQLALEPPDLARKERRSDKN

SEQ ID NO: 3987 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcggattaagacgctcgaccagctggagaagtacgttgcactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccctactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccgcgtcatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3988 - protein, 416 aa, Artificial Sequence; identical to SEQ ID NO: 3896
  Description of Artificial Sequence: Synthetic Construct

SEQ ID NO: 3989 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcggtgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatctgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggcgcgataagaactaa

SEQ ID NO: 3990 - protein, 416 aa, Artificial Sequence; identical to SEQ ID NO: 3852
  Description of Artificial Sequence: Synthetic Construct

SEQ ID NO: 3991 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcggattaagacgctcgaccagctggagaagtacgttgcactcaccgctgaagaagaagagggagtaaaagaatcgcccaaagtactccgaatggctatcacaccttattatttgagtttgatagaccccgagaatcctaattgtccgattcgtaaacaagccattcctactaaacgagaactggtacgtgctcctgaagatatggtagacccacttagtgaagatgaagattcgcccgtacccggactaactcatcgttatccggatcgtgtattgttccttatcacggacaaatgttcgatgtactgtcgtcattgtactcgccgtcgcttcgcaggacggagagatgcttcttctccttctgagcgcatcgatcgatgcattgaatatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaaggatggccaatgccggtattccgttgggtaaccaaacggttttattgcgtggaatcaatgattgtacacatgtgatgaagcgattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3992 - protein, 416 aa, Artificial Sequence
  Description of Artificial Sequence: Synthetic Construct
MAESRRKHYFPDVTDEQWYDWHWQVINRIKTLDQLEKYVALTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGRRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 3993 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcggattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcggtgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtgttccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggcgcgataagaactaa

SEQ ID NO: 3994 - protein, 416 aa, Artificial Sequence; identical to SEQ ID NO: 3886
  Description of Artificial Sequence: Synthetic Construct

SEQ ID NO: 3995 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgagaactggtacatgctcctgaagatatggtagacccacttagtgaagatgaagattcgcccgtacccggactgactcatcgttatccggatcgcgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccgatgtggctgaacactcacttcaaccacccgaatgaagttaccgaagaagcagtggaggcttgtgaaaggatggccaatgccggtattccggtgggtaaccaaacggttttattgcgtggaatcaatgattgtacacatgtgatgaagagattggtacatttgctggtaaagattcgtgtgcgtccttactatatatatgcttgcgatctttcgcttggaataggacatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccgcgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3996 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVHAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPMWLNTHFNHPNEVTEEAVEACERMANAGIPVGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 3997 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcggattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccctactatatatatgcttgcgatctttcgcttggaatagggcatttccgcacgccggtatctaagggaatcgaaattatcgaaaatttgcgcggacacacctcgggctatgcagttcccacctttgtggtacatgctccggggggtggtggtaagatacctgtagcgccgaactatgttgtatctcagtccccgcgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 3998 - protein, 416 aa, Artificial Sequence; identical to SEQ ID NO: 3260
  Description of Artificial Sequence: Synthetic Construct

SEQ ID NO: 3999 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcggattaagacgctcgaccagctggagaagtacgttacactcaccgctgaagaagaagagggagtaaaagaatcgcccaaagtactccgaatggctatcacaccttattatttgagtttgatggaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattgatacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacgacctatacggagccggaggactatcatgaggagtgcgattgtgaggactgccgtgtcgacaagcatcgtgagggcgtggctgcactttccggaggccagcagttggctttagagcctcccgacttagctcgcaaagaacgcaggagcgataagaactaa

SEQ ID NO: 4000 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLMDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLIHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4001 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttgcactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaaggatggccaatgccggtattccgttgggtaaccaaacggttttattgcgtggaatcaatgattgtacacatgtgatgaagagattggtacatttgctggtaaagattcgtgtgcgtccctactatatatatgcttgcgatctttcgcttggaataggacatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccgcgacatgtggttcttcgcaattatgaaggtgttatcacaacctatacggagccggaggactatcatgaggagtgcgattgtgaggactgccgtgtcgacaagcatcgtgagggcgtggctgcactttccggaggtcagcagttggctttagggcctcccgacttagctcgcaaagaacgcaggagcgataagaactaa

SEQ ID NO: 4002 - protein, 416 aa, Artificial Sequence
  Description of Artificial Sequence: Synthetic Construct
MAESRRKHYFPDVTDEQWYDWHWQVINRIKTLDQLEKYVALTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALGPPDLARKERRSDKN

SEQ ID NO: 4003 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccctattatttgagtttgatagaccccgagaatcctaattgtccgattcgtaaacaagccattcctactaaacgggaactggtacatgctcctgaagatatggtagacccacttagtgaagatgaagattcgcccgtacccggactaactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaaggatggccaatgccggtgttccgttgggtaaccaaacggttttattgcgtggaatcaatgattgtacacatgtgatgaagagattggtacatttgctggtaaagattcgtgtgcgtccttactatatatatgcttgcgatctttcgcttggaataggacatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4004 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVHAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGVPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4005 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcggattaagacgctcgaccagctggagaagtacgttacactcaccgctgaagaagaagagggagcaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgcgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccctactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacgacctatacggagccggaggactatcatggggagtgcgattgtgaggactgccgtgtcgacaagcatcgtgagggcgtggctgcactttccggaggtcagcagttggctttagagcctcccgacttagctcgcaaagaacgcaggagcgataagaactaa

SEQ ID NO: 4006 - protein, 416 aa, Artificial Sequence
  Description of Artificial Sequence: Synthetic Construct
MAESRRKHYFPDVTDEQWYDWHWQVINRIKTLDQLEKYVTLTAEEEEGAKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHGECDCEDCRVDKHREGVAALSGGQQLALEPPDLARKERRSDKN

SEQ ID NO: 4007 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaggtactccgaatggctatcacaccctattatttgagtttgatagaccccgagaatcctaattgtccgattcgtaaacaagccattcctactaaacgagaactggtacatgctcctgaagatatggtagacccacttagtgaagatgaagattcgcccgtacccggactaactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgagcgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtgttccgttgggtaaccaaacggttttattgcgtggaatcaatgattgtacacatgtgatgaagagattggtacatttgctggtaaagattcgtgtgcgtccctactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacgacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4008 - protein, 416 aa, Artificial Sequence; identical to SEQ ID NO: 4004
  Description of Artificial Sequence: Synthetic Construct

SEQ ID NO: 4009 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacgccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaactggtggatatgctcaaaaaatatcatccggtgtggctgaacactcacttcaaccacccgaatgaagttaccgaagaagcagtggaggcttgtgaaagaatggccaatgtcggtattccgttgggtaaccaaacggttttattgcgtggaatcaatgattgtacacatgtgatgaggagattggtacatttgctagtaaagattcgtgtgcgtccttactatatatatgcttgcgatctttcgcttggaatagggcatttccgcacgccggtatctaagggaatcgaaattatcgaaagtttgcgcggacacacctcgggctatgcagttcctacctttgtggtacatgctccggggggtggtggtaagatacctttggcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgaaggcgtggctgcgctttccggaggtcagcagttggctttagagcctcccgacttagctcgcaaagaacgcaggagcgataagaactaa

SEQ ID NO: 4010 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANVGIPLGNQTVLLRGINDCTHVMRRLVHLLVKIRVRPYYIYACDLSLGIGHFRTPVSKGIEIIESLRGHTSGYAVPTFVVHAPGGGGKIPLAPNYVVSQSPRHVVLRNYEGVITTYTEPEDYHEECDCEDCRVDKHREGVAALSGGQQLALEPPDLARKERRSDKN

SEQ ID NO: 4011 - DNA, 1251 bp, Artificial Sequence
  Description of Artificial Sequence: Synthetic Construct
atggcagaaagtcgtagaaagcattatttccctgatgccaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatctgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgctggacagagagatgcttcttctccttctgagcgcatcgaccgatgcattgagtacatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcagttggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcaccgtgagggcgtggctgcgctttccggaggtcaacagttggctttagagcctcccgacttagctcgcaaagaacgcaggagcgataagaactaa

SEQ ID NO: 4012 - protein, 416 aa, Artificial Sequence
  Description of Artificial Sequence: Synthetic Construct
MAESRRKHYFPDATDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4013 - DNA, 1251 bp, Artificial Sequence
  Description of Artificial Sequence: Synthetic Construct
atggcagaaagtcgcagaaagcattatttccctgatgtcaccgatgagcaatggtacgactggcattggcaggtcatcaatcgaattaagacgctcgaccagctggagaagtacgttacactcactgctgaagaagaagagggagtaaaagaatcgcccaaagtactccgaatggctatcacaccttattatttgagtttgatagaccccgagaatcctaattgcccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcctcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatcccgtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctagtaaagattcgtgtgcgtccttactatatatatgcttgcgatctttcgcttggaatagggcatttccgcacgccggtatctaagggaatcgaaattatcgaaagtttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4014 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRLAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIESLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4015 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcggattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtacatagccaatacgccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaactggtggatatgctcaaaaaatatcatccggtgtggctgaacactcacttcaaccacccgaatgaagttaccgaagaagcagtggaggcttgtgagagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacaccacgggccatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgaaggcgtggctgcgctttccggaggtcagcagttggctttagagcctcccgacttagctcgcaaagaacgcaggagcgataagaactaa

SEQ ID NO: 4016 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTTGHAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4017 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagagtcgcccaaagtactccgaatggctatcacaccttattatttgagtttgatagaccccgagaatcctaattgtccgattcgtaaacaagccattcctactaaacgggaactggtacgtgctcctgaggatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgagagaatggccaatgccggtattccgttgggcaaccaaacggttttattgcgtggaatcaatgattgtacacatgtgatgaagagattggtacatttgctagtaaagattcgtgtgcgtccttactatatatatgcttgcgatctttcgcttggaatagggcatttccgcacgccggtatctaagggaatcgaaattatcgaaagtttgcgcggacacacctcgggctatgcagttcctacctttgtggtacatgctccggggggtggtggtaagatacctttggcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgaaggcgtggctgcactttccggaggtcaacagttggctttagagcctcccgacttagctcgcaaagaacgcaggagcgataagaactaa

SEQ ID NO: 4018 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIESLRGHTSGYAVPTFVVHAPGGGGKIPLAPNYVVSQSPRHVVLRNYEGVITTYTEPEDYHEECDCEDCRVDKHREGVAALSGGQQLALEPPDLARKERRSDKN

SEQ ID NO: 4019 - DNA, 1251 bp, Artificial Sequence
  Description of Artificial Sequence: Synthetic Construct
atggcagaaagtcgcagaaagcattatttccctgatgtcaccgatgagcaatggtacgactggcattggcaggtcatcaatcgaattaagacgctcgaccagctggagaagtacgttacactcactgctgaagaagaagagggagtaaaagaatcgcccaaagtactccgaatggctatcacaccttattatttgagtttgatagaccccgagaatcctaattgcccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctagtaaagattcgtgtgcgtccttactatatatatgcttgcgatctttcgcttggaatagggcatttccgcacgccggtatctaagggagtcgaaattatcgaaaatttgcgcggacacacctcgggccatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4020 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGVEIIENLRGHTSGHAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4021 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacgccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgaaggcgtggctgcactttccggaggtcagcagttggctttagagccccccgacttagcccgcaaagaacgcaggagcgataagaactaa

SEQ ID NO: 4022 - protein, 416 aa, Artificial Sequence; identical to SEQ ID NO: 3260
  Description of Artificial Sequence: Synthetic Construct

SEQ ID NO: 4023 - DNA, 1251 bp, Artificial Sequence
  Description of Artificial Sequence: Synthetic Construct
atggcagaaagtcgtagaaagcattatttccctgatgccaccgatgagcaatggtacgactggcattggcaggtcatcaatcgaattaagacgctcgaccagctggagaagtacgttacactcaccgctgaagaagaagagggagtgaaagaatcgcccaaagtactccgaatggctatcacaccttattatttgagtttgatagaccccgagaatcctaattgtccgattcgtaaacaagccattcctactaaacgggaactggtacgtgctcctgaggatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaggagattggtacatttgctggtaaagattcgtgtgcgtccttactatatatatgcttgcgatctttcgcttggaatagggcatttccgcacgccggtatctaagggaatcgaaattatcgaaagtttgcgcggacacacctcgggctatgcagttcctacctttgtggtacatgctccggggggtggtggtaagatacctttggcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4024 - protein, 416 aa, Artificial Sequence
  Description of Artificial Sequence: Synthetic Construct
MAESRRKHYFPDATDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMRRLVHLLVKIRVRPYYIYACDLSLGIGHFRTPVSKGIEIIESLRGHTSGYAVPTFVVHAPGGGGKIPLAPNYVVSQSPRHVVLRNYEGVITTYTEPEDYHEECDCEDCRVDKHREGVAALSGGQQLALEPPDLARKERRSDKN

SEQ ID NO: 4025 - DNA, 1251 bp, Artificial Sequence
  Description of Artificial Sequence: Synthetic Construct
atggcagaaagtcgcagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgccgcttcgcaggacagagagatgcttcttctccttctgagcgcatcgaccgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaactggtggatatgctcaaaaaatatcatcccgtgtggctgaacactcacttcaaccacccgaatgaagttaccgaagaagcagtggaggcttgtgagagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactacgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcgctttccggaggtcagcagttggctttagagcctcccgacttagctcgcaaagaacgcaggagcgataagaactaa

SEQ ID NO: 4026 - protein, 416 aa, Artificial Sequence; identical to SEQ ID NO: 3260
  Description of Artificial Sequence: Synthetic Construct

SEQ ID NO: 4027 - DNA, 1251 bp, Artificial Sequence
  Description of Artificial Sequence: Synthetic Construct
atggcagaaagtcgcagaaagcattatttccctgatgtcaccgatgagcaatggtacgactggcattggcaggtcatcaatcgaattaagacgctcgaccagctggagaagtacgttacactcaccgctgaagaagaagagggagtaaaagagtcgcccaaagtactccgaatggctatcacaccttattatttgagtttgatagaccccgagaatcctaattgcccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacacttggaatacatattgaagcgtctgcgcgaagtacctcatgtggagattgttcgtataggaagccgtgcgccggtagtcctccctcagcgtataacgcctcaactggtggatatgctcaaaaaatatcatccggtgtggctgaacactcacttcaaccacccgaatgaagttaccgaagaagcagtggaggcttgtgagagaatggccaatgccggtattccgttgggtaaccaaacggttttattgcgtggaatcaatgattgtacacatgtgatgaggagattggtacatttgctagtaaagattcgtgtgcgtccttactatatatatgcttgcgatctttcgcttggaatagggcatttccgcacgccggtatctaagggaatcgaaattatcgaaagtttgcgcggacacacctcgggctatgcagttcctacctttgtggtacatgctccggggggtggtggtaagatacctttggcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcgctttccggaggtcagcagttggctttagagcctcccgacttagctcgcaaagaacgcaggagcgataagaactaa

SEQ ID NO: 4028 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDEHLEYILKRLREVPHVEIVRIGSRAPVVLPQRITPQLVDMLKKYHPVWLNTHFNHPNEVTEEAVEACERMANAGIPLGNQTVLLRGINDCTHVMRRLVHLLVKIRVRPYYIYACDLSLGIGHFRTPVSKGIEIIESLRGHTSGYAVPTFVVHAPGGGGKIPLAPNYVVSQSPRHVVLRNYEGVITTYTEPEDYHEECDCEDCRVDKHREGVAALSGGQQLALEPPDLARKERRSDKN

SEQ ID NO: 4029 - DNA, 1251 bp, Artificial Sequence
  Description of Artificial Sequence: Synthetic Construct
atggcagaaagtcgcagaaagcattatttccctgatgtcaccgatgagcaatggtacgactggcattggcaggtcatcaatcgaattaagacgctcgaccagctggagaagtacgttacactcaccgctgaagaagaagagggagtgaaagaatcgcccaaagtactccgaatggctatcacaccttattatttgagtttgatagaccccgagaatcctaattgcccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacacttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttgccgaagaagcagtggaggcttgtgagagaatggccaatgccggtattccgttgggtaaccaaacggttttattgcgcggaatcaatgattgcacacatgtgatgaagagattggtacatttgctggtaaagattcgtgtgcgtccttactatatgtatgcttgcgatctttcgcttggaatagggcatttccgcacgccggtatctaagggaatcgaaattatcgaaaatttgcgcggacacacctcgggccatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4030 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDEHLEYILKRLREVPHVEIVRIGSRAPVVLPQRITPQLVDMLKKYHPVWLNTHFNHPNEVAEEAVEACERMANAGIPLGNQTVLLRGINDCTHVMKRLVHLLVKIRVRPYYMYACDLSLGIGHFRTPVSKGIEIIENLRGHTSGHAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4031 - DNA, 1251 bp, Artificial Sequence
  Description of Artificial Sequence: Synthetic Construct
atggcagaaagtcgcagaaagcattatttccctgatgccaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgcccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacggagagatgcttcttctccttctgagcgcatcgaccgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcaccgtgagggcgtggctgcgctttccggaggtcagcagttggctttagagcctcccgacttagctcgcaaagaacgcaggagcgataagaactaa

SEQ ID NO: 4032 - protein, 416 aa, Artificial Sequence
  Description of Artificial Sequence: Synthetic Construct
MAESRRKHYFPDATDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGRRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4033 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtgcgtgctcctgaggatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtacatagccaatacgccgacagtccgcgatgttttgctatcgggaggcgatgccctccttgtcagcgacgaacacttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgagagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaagtttgcgcggacacacctcgggccatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4034 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDEHLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIESLRGHTSGHAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4035 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcactgctgaagaagaagagggagtaaaagaatcgcccaaagtactccgaatggctatcacaccttattatttgagtttgatagaccccgagaatcctaattgcccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgagagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaagtttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcaccgtgagggcgtggctgcgctttccggaggtcagcagttggctttagagcctcccgacttagctcgcaaagaacgcaggagcgataagaactaa

SEQ ID NO: 4036 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIESLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4037 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaactggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaagtttgcgcggacacacctcaggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4038 - protein, 416 aa, Artificial Sequence; identical to SEQ ID NO: 4036
  Description of Artificial Sequence: Synthetic Construct

SEQ ID NO: 4039 - DNA, 1251 bp, Artificial Sequence
  Description of Artificial Sequence: Synthetic Construct
atggcagaaagtcgcagaaagcattatttccctgatgtcaccgatgagcaatggtacgactggcattggcaggtcatcaatcgaattaagacgctcgaccagctggagaagtacgttacactcaccgctgaagaagaagagggagtgaaagagtcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgaccgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaggagattggtacatttgctagtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgaaggcgtggctgcgctttccggaggtcagcagttggctttagagcctcccgacttagctcgcaaagaacgcaggagcgataagaactaa

SEQ ID NO: 4040 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMRRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4041 - DNA, 1251 bp, Artificial Sequence
  Description of Artificial Sequence: Synthetic Construct
atggcagaaagtcgtagaaagcattatttccctgatgccaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaggatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtacatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgagagaatggccaatgccggtattccgttgggtaaccaaacggttttattgcgtggaatcaatgattgtacacatgtgatgaagagattggtacatttgctaataaagattcgtgtgcgtccttactatatatatgcttgcgatctttcgcttggaatagggcatttccgcacgccggtatctaagggaatcgaaattatcgaaaatttgcgcggacacacctcgggccatgcagttcctacctttgtggtacatgctccggggggtggtggtaagatacctgtagcgccgaactatgttgtatctcagtccccacgacatgtggttcttcgcaattatgaaggtgttatcacaacctatacggagccggaagactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4042 - protein, 416 aa, Artificial Sequence
  Description of Artificial Sequence: Synthetic Construct
MAESRRKHYFPDATDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLIKIRVRPYYIYACDLSLGIGHFRTPVSKGIEIIENLRGHTSGHAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4043 - DNA, 1251 bp, Artificial Sequence
  Description of Artificial Sequence: Synthetic Construct
atggcagaaagtcgcagaaagcattatttccctgatgtcaccgataagcaatggtacgactggcattggcaggtcatcaatcgaattaagacgctcgaccagctggagaagtacgttacactcaccgctgaagaagaagagggagtgaaagaatcgcccaaagtactccgaatggctatcacaccttattatttgagtttgatagaccccgagaatcctaattgcccgattcgtaaacaagccattcctactaaacgggaactggtgcgtgctcctgaggatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtacatagccaatacgccgacagtccgcgatgttttgctatcgggaggcgatgccctccttgtcagcgacgaacacttggagtacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaggagattggtacatttgctggtaaagattcgtgtgcgtccttactatatatatgcttgcgatctttcgcttggaatagggcatttccgcacgccggtatctaagggaatcgaaattatcgaaagtttgcgcggacacacctcgggctatgcagttcctacctttgtggtacatgctccggggggtggtggtaagatacctttggcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgaaggcgtggctgcactttccggaggtcagcagttggctttagagcctcccgacttagctcgcaaagaacgcaggagcgataagaactaa

SEQ ID NO: 4044 - protein, 416 aa, Artificial Sequence
  Description of Artificial Sequence: Synthetic Construct
MAESRRKHYFPDVTDKQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDEHLEYILKRLREVPHVEIVRIGSRAPVVLPQRITPQLVDMLKKYHPVWLNTHFNHPNEVTEEAVEACERMANAGIPLGNQTVLLRGINDCTHVMRRLVHLLVKIRVRPYYIYACDLSLGIGHFRTPVSKGIEIIESLRGHTSGYAVPTFVVHAPGGGGKIPLAPNYVVSQSPRHVVLRNYEGVITTYTEPEDYHEECDCEDCRVDKHREGVAALSGGQQLALEPPDLARKERRSDKN

SEQ ID NO: 4045 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgcccgattcgtaaacaagccattcctactaaacgggaactggtgcgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgaccgatgcattgagtacatagccaatacaccgacagtccgcgatgttttgctatcgggaggcgatgccctccttgtcagcgacgaacgcttggaatacatattgaagcgtctgcgcgaagtacctcatgtggagattgttcgtgtaggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaggagattggtacatttgctggtaaagattcgtgtgcgtccttactatatatatgcttgcgatctttcgcttggaatagggcatttccgcacgccggtatctaagggaatcgaaattatcgaaagtttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4046 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRVGSRAPVVLPQRITPQLVDMLKKYHPVWLNTHFNHPNEVTEEAVEACERMANAGIPLGNQTVLLRGINDCTHVMRRLVHLLVKIRVRPYYIYACDLSLGIGHFRTPVSKGIEIIESLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4047 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaggatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtacatagccaatacgccgacagtccgcgatgttttgctatcgggaggcgatgccctccttgtcagcgacgaacgcttggagtacatattgaagcgtctgcgcgaagtacctcatgtggagattgttcgtataggaagccgtgcgccggtagtcctccctcagcgtataacgcctcaattggtggatatgctcaaaaaatatcatcccgtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctagtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4048 - protein, 416 aa, Artificial Sequence; identical to SEQ ID NO: 3260
  Description of Artificial Sequence: Synthetic Construct

SEQ ID NO: 4049 - DNA, 1251 bp, Artificial Sequence
  Description of Artificial Sequence: Synthetic Construct
atggcagaaagtcgcagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgcccgattcgtaaacaagccattcctactaaacgggaactggtgcgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctagtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctttggcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgaaggcgtggctgcactttccggaggtcaacagttggctttagagcctcccgacttagctcgcaaagaacgcaggagcgataagaactaa

SEQ ID NO: 4050 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPLAPNYVVSQSPRHVVLRNYEGVITTYTEPEDYHEECDCEDCRVDKHREGVAALSGGQQLALEPPDLARKERRSDKN

SEQ ID NO: 4051 - DNA, 1251 bp, Artificial Sequence
  Description of Artificial Sequence: Synthetic Construct
atggcagaaagtcgcagaaagcattatttccctgatgtcaccgatgagcaatggtacgactggcattggcaggtcatcaatcgaattaagacgctcgaccagctggagaagtacgttacactcactgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaggatatggtagacccacttagtgaagatgtagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatcccgtgtggctgaacactcacttcaaccacccgaatgaagttaccgaagaagcagtggaggcttgtgaaagaatggccaatgccggtattccgttgggtaaccaaacggttttattgcgtggaatcaatgattgcacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcaccgtgagggcgtggctgcactttccggaggtcaacagttggctttagagcctcccgacttagctcgcaaagaacgcaggagcgataagaactaa

SEQ ID NO: 4052 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDVDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4053 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacgctcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggagtacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaggagattggtacatttgctagtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4054 - protein, 416 aa, Artificial Sequence; identical to SEQ ID NO: 4040
  Description of Artificial Sequence: Synthetic Construct

SEQ ID NO: 4055 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagagtcgcccaaagtactccgaatggctatcacaccttattatttgagtttgatagaccccgagaatcctaattgtccgattcgtaaacaagccattcctactaaacgggaactggtgcgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacgccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctagtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4056 - protein, 416 aa, Artificial Sequence; identical to SEQ ID NO: 3260
  Description of Artificial Sequence: Synthetic Construct

SEQ ID NO: 4057 - DNA, 1251 bp, Artificial Sequence
  Description of Artificial Sequence: Synthetic Construct
atggcagaaagtcgtagaaagcattatttccctgatgccaccgataagcaatggtacgactggcattggcaggtcatcaatcgaattaagacgctcgaccagctggagaagtacgttacactcaccgctgaagaagaagagggagtgaaagagtcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaggagattggtacatttgctagtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4058 - protein, 416 aa, Artificial Sequence
  Description of Artificial Sequence: Synthetic Construct
MAESRRKHYFPDATDKQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMRRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4059 - DNA, 1251 bp, Artificial Sequence
  Description of Artificial Sequence: Synthetic Construct
atggcagaaagtcgcagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgcccgattcgtaaacaagccattcctactaaacgggaactggtgcgtgctcctgaggatatggtagacccacttagtgaagatgaagattcgcccgtacccggactgacacatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttgccgaagaagcagtggaggcttgtgaaagaatggccaatgccggtattccgttgggtaaccaaacggttttattgcgtggaatcaatgattgcacacatgtgatgaagagattggtacatttgctagtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcaccgtgagggcgtggctgcactttccggaggtcagcagttggctttagagcctcccgacttagctcgcaaagaacgcaggagcgataagaactaa

SEQ ID NO: 4060 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVAEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4061 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgaccgatgcattgagtacatagccaatacgccgacagtccacgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaggagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggccatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgaaggcgtggctgcactttccggaggtcagcagttggctttagagcctcccgacttagctcgcaaagaacgcaggagcgataagaactaa

SEQ ID NO: 4062 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVHDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMRRLVHLLVKIRVRPYYIYACDLSLGIGHFRTPVSKGIEIIENLRGHTSGHAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4063 - DNA, 1251 bp, Artificial Sequence
  Description of Artificial Sequence: Synthetic Construct
atggcagaaagtcgcagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgcccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatcccgtgtggctgaacactcacttcaaccacccgaatgaagttgccgaagaagcagtggaggcttgtgagagaatggccaatgccggtattccgttgggtaaccaaacggttttattgcgtggaatcaatgattgtacacatgtgatgaggagattggtacatttgctagtaaagattcgtgtgcgtccttactatatatatgcttgcgatctttcgcttggaatagggcatttccgcacgccggtatctaagggaatcgaaattatcgaaagtttgcgcggacacacctcgggctatgcagttcctacctttgtggtacatgctccggggggtggtggtaagatacctttggcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4064 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVAEEAVEACERMANAGIPLGNQTVLLRGINDCTHVMRRLVHLLVKIRVRPYYIYACDLSLGIGHFRTPVSKGIEIIESLRGHTSGYAVPTFVVHAPGGGGKIPLAPNYVVSQSPRHVVLRNYEGVITTYTEPEDYHEECDCEDCRVDKHREGVAALSGGQQLALEPPDLARKERRSDKN

SEQ ID NO: 4065 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaggatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaactggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggccatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4066 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGHAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4067 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcccaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaactggtggatatgctcaaaaaatatcatccggtgtggctgaacactcacttcagccacccgaatgaagttaccgaagaagcagtggaggcttgtgagagaatggccaatgccggtattccgttgggtaaccaaacggttttattgcgtggaatcaatgattgtacacatgtgatgaggagattggtacatttgctagtaaagattcgtgtgcgtccttactatatatatgcttgcgatctttcgcttggaatagggcatttccgcacgccggtatctaagggaatcgaaattatcgaaagtttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4068 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFSHPNEVTEEAVEACERMANAGIPLGNQTVLLRGINDCTHVMRRLVHLLVKIRVRPYYIYACDLSLGIGHFRTPVSKGIEIIESLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4069 - DNA, 1251 bp, Artificial Sequence
  Description of Artificial Sequence: Synthetic Construct
atggcagaaagtcgtagaaagcattatttccctgatgccaccgatgagcaatggtacgactggcattggcaggtcatcaatcgaattaagacgctcgaccagctggagaagtacgttacactcactgctgaagaagaagagggagtaaaagaatcgcccaaagtactccgaatggctatcacaccttattatttgagtttgatagaccccgagaatcctaattgcccgattcgtaaacaagccattcctactaaacgggaactggtacgtgctcctgaagatatggtagacccacttagtgaggatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggagtacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgagagaatggccaatgccggtattccgttgggtaaccaaacggttttattgcgtggaatcaatgattgtacacatgtgatgaggagattggtacatttgctagtaaagattcgtgtgcgtccttactatatatatgcttgcgatctttcgcttggaatagggcatttccgcacgccggtatctaagggaatcgaaattatcgaaaatttgcgcggacacacctcgggccatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcaccgtgagggcgtggctgcgctttccggaggtcagcagttggctttagagcctcccgacttagctcgcaaagaacgcaggagcgataagaactaa

SEQ ID NO: 4070 - protein, 416 aa, Artificial Sequence
  Description of Artificial Sequence: Synthetic Construct
MAESRRKHYFPDATDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMRRLVHLLVKIRVRPYYIYACDLSLGIGHFRTPVSKGIEIIENLRGHTSGHAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4071 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtgaaagagtcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaactggtggatatgctcaaaaaatatcatccggtgtggctgaacactcacttcaaccacccgaatgaagttgccgaagaagcagtggaggcttgtgaaagaatggccaatgccggtattccgttgggtaaccaaacggttttattgcgtggaatcaatgattgtacacatgtgatgaagagattggtacatttgctagtaaagattcgtgtgcgtccttactatatatatgcttgcgatctttcgcttggaatagggcatttccgcacgccggtatctaagggaatcgaaattatcgaaagtttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4072 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVAEEAVEACERMANAGIPLGNQTVLLRGINDCTHVMKRLVHLLVKIRVRPYYIYACDLSLGIGHFRTPVSKGIEIIESLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4073 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaactggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggccatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4074 - protein, 416 aa, Artificial Sequence; identical to SEQ ID NO: 4066
  Description of Artificial Sequence: Synthetic Construct

SEQ ID NO: 4075 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggggtaaaagaatcgcccaaagtactccgaatggctatcacaccttattatttgagtttgatagaccccgagaatcctaattgtccgattcgtaaacaagccattcctactaaacgggaactggtgcgtgctcctgaggatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgagagaatggccaatgccggtattccgttgggtaaccaaacggttttattgcgtggaatcaatggttgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4076 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINGCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4077 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgacagaccccgagaatcctaattgcccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgagagaatggccaatgccggtattccgttgggtaaccaaacggttttattgcgtggaatcaatgattgtacacatgtgatgaggagattggtacatttgctagtaaagattcgtgtgcgtccttactatatatatgcttgcgatctttcgcttggaatagggcatttccgcacgccggtatctaagggaatcgaaattatcgaaagtttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4078 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLTDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMRRLVHLLVKIRVRPYYIYACDLSLGIGHFRTPVSKGIEIIESLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4079 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgcccgattcgtaaacaagccattcctactaaacgggaactggtgcgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgaccgatgcattgagtatatagccaatacgccgacagtccgcgatgttttgctatcgggaggcgatgccctccttgtcagcgacgaacgcttggagtacatattgaagcgtctgcgcgaagtacctcatgtggagattgttcgtataggaagccgtgcgccggtagtcctccctcagcgtataacgcctcaactggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggccatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4080 - protein, 416 aa, Artificial Sequence; identical to SEQ ID NO: 4066
  Description of Artificial Sequence: Synthetic Construct

SEQ ID NO: 4081 - DNA, 1251 bp, Artificial Sequence
  Description of Artificial Sequence: Synthetic Construct
atggcagaaagtcgcagaaagcattatttccctgatgtcaccgatgagcaatggtacgactggcattggcaggtcatcaatcgaattaagacgctcgaccagctggagaagtacgttacactcaccgctgaagaagaagagggagtgaaagaatcgcccaaagtactccgaatggctatcacaccttattatttgagtttgatagaccccgagaatcctaattgtccgattcgtaaacaagccattcctactaaacgggaactggtgcgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacgccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttgccgaagaagcagtggaggcttgtgaaagaatggccaatgccggtattccgttgggtaaccaaacggttttattgcgtggaatcaatgattgtacacatgtgatgaggagattggtacatttgctagtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcaccgtgagggcgtggctgcactttccggaggtcaacagttggctttagagcctcccgacttagctcgcaaagaacgcaggagcgataagaactaa

SEQ ID NO: 4082 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVAEEAVEACERMANAGIPLGNQTVLLRGINDCTHVMRRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4083 - DNA, 1251 bp, Artificial Sequence
  Description of Artificial Sequence: Synthetic Construct
atggcagaaagtcgcagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacgccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttgccgaagaagcagtggaggcttgtgagagaatggccaatgccggtattccgttgggtaaccaaacggttttattgcgtggaatcaatgattgtacacatgtgatgaggagattggtacatttgctagtaaagattcgtgtgcgtccttactatatatatgcttgcgatctttcgcttggaatagggcatttccgcacgccggtatctaagggaatcgaaattatcgaaagtttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4084 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVAEEAVEACERMANAGIPLGNQTVLLRGINDCTHVMRRLVHLLVKIRVRPYYIYACDLSLGIGHFRTPVSKGIEIIESLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4085 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgcccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgaccgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgcacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggccatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4086 - protein, 416 aa, Artificial Sequence; identical to SEQ ID NO: 4066
  Description of Artificial Sequence: Synthetic Construct

SEQ ID NO: 4087 - DNA, 1251 bp, Artificial Sequence
  Description of Artificial Sequence: Synthetic Construct
atggcagaaagtcgcagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgcccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgaccgatgcattgagtatatagccaatacaccgacagtccgcgatgttttgctatcgggaggcgatgccctccttgtcagcgacgaacgcttggagtacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgagagaatggccaatgccggtattccgttgggtaaccaaacggttttattgcgtggaatcaatgattgtacacatgtgatgaggagattggtacatttgttggtaaagattcgtgtgcgtccttactatatatatgcttgcgatctttcgcttggaatagggcatttccgcacgccggtatctaagggaatcgaaattatcgaaagtttgcgcggacacacctcgggccatgcagttcctaccttcgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcaccgtgaaggcgtggctgcactttccggaggtcagcagttggctttagagcctcccgacttagctcgcaaagaacgcaggagcgataagaactaa

SEQ ID NO: 4088 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMRRLVHLLVKIRVRPYYIYACDLSLGIGHFRTPVSKGIEIIESLRGHTSGHAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4089 - DNA, 1251 bp, Artificial Sequence
  Description of Artificial Sequence: Synthetic Construct
atggcagaaagtcgcagaaagcattatttccctgatgccaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtgcgtgctcctgaggatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtaccccatgtggagattgttcgtataggaagccgtgcgccggtagtcctccctcagcgtataacgcctcaattggtggatatgctcaaaaaatatcatcccgtgtggctgaacactcacttcaaccacccgaatgaagttgccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctacacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4090 - protein, 416 aa, Artificial Sequence
  Description of Artificial Sequence: Synthetic Construct
MAESRRKHYFPDATDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVAEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4091 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgcccgattcgtaaacaagccattcctactaaacgggaactggtgcgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggccatgcagttcctacctttgtggtacatgctccggggggtggtggtaagatacctgtagcgccgaactatgttgtatctcagtccccccgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4092 - protein, 416 aa, Artificial Sequence; identical to SEQ ID NO: 4066
  Description of Artificial Sequence: Synthetic Construct

SEQ ID NO: 4093 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtgcgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaactggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaggagattggtacatttgctggtaaagattcgtgtgcgtccttactatatatatgcttgcgatctttcgcttggaatagggcatttccgcacgccggtatctaagggaatcgaaattatcgaaagtttgcgcggacacacctcgggccatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcaccgtgagggcgtggctgcactttccggaggtcagcagttggctttagagcctcccgacttagctcgcaaagaacgcaggagcgataagaactaa

SEQ ID NO: 4094 - protein, 416 aa, Artificial Sequence; identical to SEQ ID NO: 4088
  Description of Artificial Sequence: Synthetic Construct

SEQ ID NO: 4095 - DNA, 1251 bp, Artificial Sequence
  Description of Artificial Sequence: Synthetic Construct
atggcagaaagtcgcagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgcccgattcgtaaacaagccattcctactaaacgggaactggtgcgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgaccgatgcattgagtacatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggccatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4096 - protein, 416 aa, Artificial Sequence; identical to SEQ ID NO: 4066
  Description of Artificial Sequence: Synthetic Construct

SEQ ID NO: 4097 - DNA, 1251 bp, Artificial Sequence
  Description of Artificial Sequence: Synthetic Construct
atggcagaaagtcgcagaaagcattatttccctgatgccaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgcccgattcgtaaacaagccattcctactaaacgggaactggtgcgtgctcctgaggatatggtagacccacttagtgaagatgaagattcgcccgtacccggactgactcatcgttatccggatcgtgtattgttccttatcacggacaaatgttcggtgtactgtcgtcattgtactcgccgtcgcttcgcaggacagagagatgcttcttctccttctgagcgcatcgatcgatgcattgagtatatagccaatacgccgacagtccgcgatgttttgctatcgggaggcgatgccctccttgtcagcgacgaacgcttggaatacatattgaggcgtctgcgcgaagtacctcatgtggagattgttcgtataggaagccgtgcgccggtagtcctccctcagcgtataacgcctcaattggtggatatgctcaaaaaatatcatcccgtgtggctgaacactcacttcaaccacccgaatgaagttgccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4098 - protein, 416 aa, Artificial Sequence
  Description of Artificial Sequence: Synthetic Construct
MAESRRKHYFPDATDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSVYCRHCTRRRFAGQRDASSPSERIDRCIEYIANTPTVRDVLLSGGDALLVSDERLEYILRRLREVPHVEIVRIGSRAPVVLPQRITPQLVDMLKKYHPVWLNTHFNHPNEVAEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4099 - DNA, 1251 bp, Artificial Sequence
  Description of Artificial Sequence: Synthetic Construct
atggcagaaagtcgcagaaagcattatttccctgatgtcaccgatgagcaatggtacgactggcattggcaggtcatcaatcgaattaagacgctcgaccagctggagaagtacgttacactcaccgctgaagaagaagagggagtgaaagagtcgcccaaagtactccgaatggctatcacaccttattatttgagtttgatagaccccgagaatcctaattgtccgattcgtaaacaagccattcctactaaacgggaactggtgcgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgaccgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatcccgtgtggctgaacactcacttcaaccacccgaatgaagttgccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaagtttgcgcggacacacctcgggctatgcggttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4100 - protein, 416 aa, Artificial Sequence; identical to SEQ ID NO: 4072
  Description of Artificial Sequence: Synthetic Construct

SEQ ID NO: 4101 - DNA, 1251 bp, Artificial Sequence
  Description of Artificial Sequence: Synthetic Construct
atggcagaaagtcgtagaaagcattatttccctgatgccaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctagtaaagattcgtgtgcgtccttactatatatatgcttgcgatctttcgcttggaatagggcatttccgcacgccggtatctaagggaatcgaaattatcgaaagtttgcgcggacacacctcgggctatgcagttcctacctttgtggtacatgctccggggggtggtggtaagatacctttggcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4102 - protein, 416 aa, Artificial Sequence
  Description of Artificial Sequence: Synthetic Construct
MAESRRKHYFPDATDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIESLRGHTSGYAVPTFVVHAPGGGGKIPLAPNYVVSQSPRHVVLRNYEGVITTYTEPEDYHEECDCEDCRVDKHREGVAALSGGQQLALEPPDLARKERRSDKN

SEQ ID NO: 4103 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgagttaagacgctcgaccagctggagaagtacgttacactcaccgctgaagaagaagagggagtgaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacgccgacagtccgcgatgttttgctatcgggaggcgatgccctccttgtcagcgacgaacgcttggagtacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgcacacatgtgatgaagagattggtacatttgctggtaaagattcgtgtgcgtccttactatatatatgcttgcgatctttcgcttggaatagggcatttccgcacgccggtatctaagggaatcgaaattatcgaaagtttgcgcggacacacctcgggctatgcagttcctacctttgtggtacatgctccggggggtggtggtaagatacctttggcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcgctttccggaggtcagcagttggctttagagcctcccgacttagctcgcaaagaacgcaggagcgataagaactaa

SEQ ID NO: 4104 - protein, 416 aa, Artificial Sequence
  Description of Artificial Sequence: Synthetic Construct
MAESRRKHYFPDVTDEQWYDWHWQVINRVKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIESLRGHTSGYAVPTFVVHAPGGGGKIPLAPNYVVSQSPRHVVLRNYEGVITTYTEPEDYHEECDCEDCRVDKHREGVAALSGGQQLALEPPDLARKERRSDKN

SEQ ID NO: 4105 - DNA, 1251 bp, Artificial Sequence
  Description of Artificial Sequence: Synthetic Construct
atggcagaaagtcgcagaaagcattatttccctgatgtcaccgatgagcaatggtacgactggcattggcaggtcatcaatcgaattaagacgctcgaccagctggagaagtacgttacactcactgctgaagaagaagagggagtaaaagagtcgcccaaagtactccgaatggctatcacaccttattatttgagtttgatagaccccgagaatcctaattgcccgattcgtaaacaagccattcctactaaacgggaactggtacgtgctcctgaggatatggtagacccacttagtgaagataaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacgccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctagtaaagattcgtgtgcgtccttactatatatatgcttgcgatctttcgcttggaatagggcatttccgcacgccggtatctaagggaatcgaaattatcgaaagtttgcgcggacacacctcgggccatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgaaggcgtggctgcactttccggaggtcagcagttggctttagagcctcccgacttagctcgcaaagaacgcaggagcgataagaactaa

SEQ ID NO: 4106 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDKDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIESLRGHTSGHAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4107 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtgaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtacatagccaatacaccgacagtccgcgatgttttgctatcgggaggcgatgccctccttgtcagcgacgaacgcttggagtacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttgccgaagaagcagtggaggcttgtgaaagaatggccaatgccggtattccgttgggtaaccaaacggttttattgcgtggaatcaatgattgtacacatgtgatgaggagattggtacatttgctagtaaagattcgtgtgcgtccttactatatatatgcttgcgacctttcgcttggaatagggcatttccgcacgccggtatctaagggaatcgaaattatcgaaaatttgcgcggacacacctcgggccatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgaaggcgtggctgcactttccggaggtcagcagttggctttagagcctcccgacttagctcgcaaagaacgcaggagcgataagaactaa

SEQ ID NO: 4108 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVAEEAVEACERMANAGIPLGNQTVLLRGINDCTHVMRRLVHLLVKIRVRPYYIYACDLSLGIGHFRTPVSKGIEIIENLRGHTSGHAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4109 - DNA, 1251 bp, Artificial Sequence
  Description of Artificial Sequence: Synthetic Construct
atggcagaaagtcgcagaaagcattatttccctgatgtcaccgatgagcaatggtacgactggcattggcaggtcatcaatcgaattaagacgctcgaccagctggagaagtacgttacactcaccgctgaagaagaagagggagtgaaagaatcgcccaaagtactccgaatggctatcacaccttattatttgagtttgatagaccccgagaatcctaattgcccgattcgtaaacaagccattcctactaaacgggaactggtgcgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtacatagccaatacgccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctagtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcgctttccggaggtcagcagttggctttagagcctcccgacttagctcgcaaagaacgcaggagcgataagaactaa

SEQ ID NO: 4110 - protein, 416 aa, Artificial Sequence; identical to SEQ ID NO: 3260
  Description of Artificial Sequence: Synthetic Construct

SEQ ID NO: 4111 - DNA, 1251 bp, Artificial Sequence
  Description of Artificial Sequence: Synthetic Construct
atggcagaaagtcgcagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgcccgattcgtaaacaagccattcctactaaacgggaactggtgcgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgaccgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgcacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggccatgcagttcctacctttgtggtacatgctccggggggtggtggtaagatacctgtggcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4112 - protein, 416 aa, Artificial Sequence; identical to SEQ ID NO: 4066
  Description of Artificial Sequence: Synthetic Construct

SEQ ID NO: 4113 - DNA, 1251 bp, Artificial Sequence
  Description of Artificial Sequence: Synthetic Construct
atggcagaaagtcgcagaaagcattatttccctgatgccaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtgcgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatctccgcacgccggtatctaagggaatcgaaattatcgaaaatttgcgcggacacacctcgggccatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcgctttccggaggtcagcagttggctttagagcctcccgacttagctcgcaaagaacgcaggagcgataagaactaa

SEQ ID NO: 4114 - protein, 416 aa, Artificial Sequence
  Description of Artificial Sequence: Synthetic Construct
MAESRRKHYFPDATDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHLRTPVSKGIEIIENLRGHTSGHAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4115 - DNA, 1251 bp, Artificial Sequence
  Description of Artificial Sequence: Synthetic Construct
atggcagaaagtcgcagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtgcgtgctcctgaggatatggtagacccacttagtgaagatgaagattcgcccgtgcccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggagtacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttgggatagggcatttccgcacgccggtatctaagggaatcgaaattatcgaaaatttgcgcggacacacctcgggccatgcagttcctacctttgtggtacatgctccggggggtggtggtaagatacctttggcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctctagagcctcccgacttagctcgcaaagaacgcaggagcgataagaactaa

SEQ ID NO: 4116 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGHAVPTFVVHAPGGGGKIPLAPNYVVSQSPRHVVLRNYEGVITTYTEPEDYHEECDCEDCRVDKHREGVAALSGGQQLALEPPDLARKERRSDKN

SEQ ID NO: 4117 - DNA, 1251 bp, Artificial Sequence
  Description of Artificial Sequence: Synthetic Construct
atggcagaaagtcgcagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaggatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacacttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctttggcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4118 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDEHLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPLAPNYVVSQSPRHVVLRNYEGVITTYTEPEDYHEECDCEDCRVDKHREGVAALSGGQQLALEPPDLARKERRSDKN

SEQ ID NO: 4119 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtgaaagaatcgcccaaagtactccgaatggctatcacaccttattatttgagtttgatagaccccgagaatcctaattgcccgattcgtaaacaagccattcctactaaacgggaactggtacgtgctcctgaggatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgaccgatgcattgagtatatagccaatacaccgacagtccgcgatgttttgctatcgggaggcgataccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgcacacatgtgatgaggagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcaccgtgagggcgtggctgcactttccggaggtcagcagttggctttagagcctcccgacttagctcgcaaagaacgcaggagcgataagagctaa

SEQ ID NO: 4120 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDTLLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMRRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKS

SEQ ID NO: 4121 - DNA, 1251 bp, Artificial Sequence
  Description of Artificial Sequence: Synthetic Construct
atggcagaaagtcgcagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggagtacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgagagaatggccaatgccggtattccgttgggtaaccaaacggttttattgcgtggaatcaatgattgcacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgctgttcctacctttgtggtacatgctccggggggtggtggtaagatacctttggcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4122 - protein, 416 aa, Artificial Sequence; identical to SEQ ID NO: 4050
  Description of Artificial Sequence: Synthetic Construct

SEQ ID NO: 4123 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgcccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttccgagcgcatcgatcgatgcattgagtacatagccaatacgccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttgccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcgctttccggaggtcagcagttggctttagagcctcccgacttagctcgcaaagaacgcaggagcgataagaactaa

SEQ ID NO: 4124 - protein, 416 aa, Artificial Sequence; identical to SEQ ID NO: 4060
  Description of Artificial Sequence: Synthetic Construct

SEQ ID NO: 4125 - DNA, 1251 bp, Artificial Sequence
  Description of Artificial Sequence: Synthetic Construct
atggcagaaagtcgcagaaagcattatttccctgatgccaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaggagattggtacatttgctagtaaagattcgtgtgcgtccttactatatatatgcttgcgatctttcgcttggaatagggcatttccgcacgccggtatctaagggaatcgaaattatcgaaagtttgcgcggacacacctcgggccatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgaaggcgtggctgcactttccggaggtcagcagttggctttagagcctcccgacttagctcgcaaagaacgcaggagcgataagaactaa

SEQ ID NO: 4126 - protein, 416 aa, Artificial Sequence
  Description of Artificial Sequence: Synthetic Construct
MAESRRKHYFPDATDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMRRLVHLLVKIRVRPYYIYACDLSLGIGHFRTPVSKGIEIIESLRGHTSGHAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4127 - DNA, 1251 bp, Artificial Sequence
  Description of Artificial Sequence: Synthetic Construct
atggcagaaagtcgcagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgagagaatagccaatgccggtattccgttgggtaaccaaacggttttattgcgtggaatcaatgattgtacacatgtgatgaggagattggtacatttgctagtaaagattcgtgtgcgtccttactatatatatgcttgcgatctttcgcttggaatagggcatttccgcacgccggtatctaagggaatcgaaattatcgaaagtttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4128 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERIANAGIPLGNQTVLLRGINDCTHVMRRLVHLLVKIRVRPYYIYACDLSLGIGHFRTPVSKGIEIIESLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4129 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatggaccccgagaatcctaattgcccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctaataaagattcgtgtgcgtccttactatatatatgcttgcgatctttcgcttggaatagggcatttccgcacgccggtatctaagggaatcgaaattatcgaaagtttgcgcggacacacctcgggccatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgtggactgccgagtcgacaagcatcgtgagggcgtggctgcactttccggaggtcagcagttggctttagagcctcccgacttagctcgcaaagaacgcaggagcgataagaactaa

SEQ ID NO: 4130 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLMDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLIKIRVRPYYIYACDLSLGIGHFRTPVSKGIEIIESLRGHTSGHAVPTFVVHAPGGGGKIPVAPNYVVSQSPRHVVLRNYEGVITTYTEPEDYHEECDCVDCRVDKHREGVAALSGGQQLALEPPDLARKERRSDKN

SEQ ID NO: 4131 - DNA, 1251 bp, Artificial Sequence
  Description of Artificial Sequence: Synthetic Construct
atggcagaaagtcgcagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagacctcgagaatcctaattgtccgattcgtaaacaagccattcctactaaacgggaactggtgcgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacaatccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatcccgtgtggctgaacactcacttcaaccacccgaatgaagttaccgaagaagcagtggaggcttgtgagagaatggccaatgccggtattccgttgggtaaccaaacggttttattgcgtggaatcaatgattgtacacatgtgatgaagagattggtacatttgctagtaaagattcgtgtgcgtccttactatatatatgcttgcgatctttcgcttggaatagggcatttccgcacgccggtatctaagggaatcgaaattatcgaaagtttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggttttagagcctcccgacttagctcgcaaagaacgcaggagcgataagaactaa

SEQ ID NO: 4132 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDLENPNCPIRKQAIPTKRELVRAPEDMVDPLSEDEDSPVPGLTHRYPDRVLFLITDKCSMYCRHCTRRRFAGQRDASSPSERIDRCIEYIANTPTIRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIESLRGHTSGYAVPTFVVHAPGGGGKIPVAPNYVVSQSPRHVVLRNYEGVITTYTEPEDYHEECDCEDCRVDKHREGVAALSGGQQLVLEPPDLARKERRSDKN

SEQ ID NO: 4133 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgcccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatcccgtgtggctgaacactcacttcaaccacccgaatgaagttgccgaagaagcagtggaggcttgtgagagaatggccaatgccggtattccgttgggtaaccaaacggttttattgcgtggaatcaatgattgtacacatgtgatgaggagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcgctttccggaggtcagcagttggctttagagcctcccgacttagctcgcaaagaacgcaggagcgataagaactaa

SEQ ID NO: 4134 - protein, 416 aa, Artificial Sequence; identical to SEQ ID NO: 4082
  Description of Artificial Sequence: Synthetic Construct

SEQ ID NO: 4135 - DNA, 1251 bp, Artificial Sequence
  Description of Artificial Sequence: Synthetic Construct
atggcagaaagtcgcagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtacatagccaatacgccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcggcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcgctttccggaggtcagcagttggctttagagcctcccgacttagctcgcaaagaacgcaggagcgataagaactaa

SEQ ID NO: 4136 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPRRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4137 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgaccgatgcattgagtatatagccaatacgccgacagtccgcgatgttttgctatcgggaggcgatgccctccttgtcagcgacgaacacttggagtacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttgccgaagaagcagtggaggcttgtgaaagaatggccaatgccggtattccgttgggtaaccaaacggttttattgcgtggaatcaatgattgtacacatgtgatgaggagattggtacatttgctggtaaagattcgtgtgcgtccttactatatatatgcttgcgatctttcgcttggaatagggcatttccgcacgccggtatctaagggaatcgaaattatcgaaaatctgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcaccgtgagggcgtggctgcactttccggaggtcagcagttggctttagagcctcccgacttagctcgcaaagaacgcaggagcgataagaactaa

SEQ ID NO: 4138 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDEHLEYILKRLREVPHVEIVRIGSRAPVVLPQRITPQLVDMLKKYHPVWLNTHFNHPNEVAEEAVEACERMANAGIPLGNQTVLLRGINDCTHVMRRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4139 - DNA, 1251 bp, Artificial Sequence
  Description of Artificial Sequence: Synthetic Construct
atggcagaaagtcgcagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacgccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgagagaatggccaatgccggtattccgttgggtaaccaaacggttttattgcgtggaatcaatgattgtacacatgtgatgaagagattggtacatttgctagtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcaacagttggctttagagcctcccgacttagctcgcaaagaacgcaggagcgataagaactaa

SEQ ID NO: 4140 - protein, 416 aa, Artificial Sequence; identical to SEQ ID NO: 3260
  Description of Artificial Sequence: Synthetic Construct

SEQ ID NO: 4141 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgcccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgaccgatgcattgagtatatagccaatacaccgacagtccgcgatgttttgctatcgggaggcgatgccctccttgtcagcgacgaacacttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaggagattggtacatttgctagtaaagattcgtgtgcgtccttactatatatatgcttgcgatctttcgcttggaatagggcatttccgcacgccggtatctaagggaatcgaaattatcgaaagtttgcgcggacacacctcgggccatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4142 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDEHLEYILKRLREVPHVEIVRIGSRAPVVLPQRITPQLVDMLKKYHPVWLNTHFNHPNEVTEEAVEACERMANAGIPLGNQTVLLRGINDCTHVMRRLVHLLVKIRVRPYYIYACDLSLGIGHFRTPVSKGIEIIESLRGHTSGHAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4143 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgcccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacgccgacagtccgcgatgttttgctatcgggaggcgatgccctccttgtcagcgacgaacgcttggagtacatattgaagcgtctgcgcgaagtacctcatgtggagattgttcgtataggaagccgtgcgccggtagtcctccctcagcgtataacgcctcaattggtggatatgctcaaaaaatatcatcccgtgtggctgaacactcacttcaaccacccgaaagaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaagtttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgggggcgtggctgcactttccggaggtcagcagttggctttagagcctcccgacttagctcgcaaagaacgcaggagcgataagaactaa

SEQ ID NO: 4144 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPKEVTEEAVEACERMANAGIPLGNQTVLLRGINDCTHVMKRLVHLLVKIRVRPYYIYACDLSLGIGHFRTPVSKGIEIIESLRGHTSGYAVPTFVVHAPGGGGKIPVAPNYVVSQSPRHVVLRNYEGVITTYTEPEDYHEECDCEDCRVDKHRGGVAALSGGQQLALEPPDLARKERRSDKN

SEQ ID NO: 4145 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgcccgattcgtaaacaagccattcctactaaacgggaactggtgcgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgatgaacgcttggaatacatattgaagcgtctgcgcgaagtacctcatgtggagattgttcgtataggaagccgtgcgccggtagtcctccctcagcggataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagtcggaggactatcatgaggagtgcgattgtgaggactgccgagtcgacaagcatcgtgagggcgtggctgcgctttccggaggtcagcagttggctttagagcctcccgacttagctcgcaaagaacgcaggagcgataagaactaa

SEQ ID NO: 4146 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTESEDYHEECDCEDCRVDKHREGVAALSGGQQLALEPPDLARKERRSDKN

SEQ ID NO: 4147 - DNA, 1251 bp, Artificial Sequence
  Description of Artificial Sequence: Synthetic Construct
atggcagaaagtcgtagaaagcattatttccctgatgccaccgatgagcaatggtacgactggcattggcaggtcatcaatcgaattaagacgctcgaccagctggagaagtacgttacactcactgctgaagaagaagagggagtaaaagaatcgcccaaagtactccgaatggctatcacaccttattatttgagtttgatagaccccgagaatcctaattgcccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgaccgatgcattgagtacatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaactggtggatatgctcaaaaaatatcatccggtgtggctgaacactcacttcaaccacccgaatgaagttaccgaagaagcagtggaggcttgtgagagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggccatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcaccgtgagggcgtggctgcgctttccggaggtcagcagttggctttagagcctcccgacttagctcgcaaagaacgcaggagcgataagaactaa

SEQ ID NO: 4148 - protein, 416 aa, Artificial Sequence
  Description of Artificial Sequence: Synthetic Construct
MAESRRKHYFPDATDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGHAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4149 - DNA, 1251 bp, Artificial Sequence
  Description of Artificial Sequence: Synthetic Construct
atggcagaaagtcgcagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgcccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgaccgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaactggtggatatgctcaaaaaatatcatccggtgtggctgaacactcacttcaaccacccgaatgaagttaccgaagaagcagtggaggcttgtgagagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggccatgcagttcctacctttgtggtacatgctccggggggtggtggtaagatacctttggcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4150 - protein, 416 aa, Artificial Sequence; identical to SEQ ID NO: 4116
  Description of Artificial Sequence: Synthetic Construct

SEQ ID NO: 4151 - DNA, 1251 bp, Artificial Sequence
  Description of Artificial Sequence: Synthetic Construct
atggcagaaagtcgcagaaagcattatttccctgatgtcaccgatgagcaatggtacgactggcattggcaggtcatcaatcgaattaagacgctcgaccagctggagaagtacgttacactcaccgctgaagaagaagagggagtgaaagaatcgcccaaagtactccgaatggctatcacaccttattatttgagtttgatagaccccgagaatcctaattgtccgattcgtaaacaagccattcctactaaacgggaactggtgcgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgaccgatgcattgagtatatagccaatacaccgacagtccgcgatgttttgctatcgggaggcgatgccctccttgtcagcgacgaacgcttggagtacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttgccgaagaagcagtggaggcttgtgaaagaatggccaatgccggtattccgttgggtaaccaaacggttttattgcgtggaatcaatgattgtacacatgtgatgaagagattggtacatttgctagtaaagattcgtgtgcgtccttactatatatatgcttgcgatctttcgcttggaatagggcatttccgcacgccggtatctaagggaatcgaaattatcgaaagtttgcgcggacacacctcgggccatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4152 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVAEEAVEACERMANAGIPLGNQTVLLRGINDCTHVMKRLVHLLVKIRVRPYYIYACDLSLGIGHFRTPVSKGIEIIESLRGHTSGHAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4153 - DNA, 1251 bp, Artificial Sequence
  Description of Artificial Sequence: Synthetic Construct
atggcagaaagtcgcagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgaccgatgcattgagtacatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaggaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcaccgtgaaggcgtggctgcgctttccggaggtcagcagttggctttagagcctcccgacttagctcgcaaagaacgcaggagcgataagaactaa

SEQ ID NO: 4154 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACEGMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4155 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaggagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggccatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4156 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMRRLVHLLVKIRVRPYYIYACDLSLGIGHFRTPVSKGIEIIENLRGHTSGHAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4157 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcactgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgaccgatgcattgagtatatagccaatacaccgacagtccgcgatgttttgctatcgggaggcgatgccctccttgtcagcgacgaacgcttggagtacatattgaagcgtctgcgcgaagtacctcatgtggagattgttcgtataggaagccgtgcgccggtagtcctccctcagcgtataacgcctcaactggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaggagattggtacatttgctagtaaagattcgtgtgcgtccttactatatatatgcttgcgatctttcgcttggaatagggcatttccgcacgccggtatctaagggaatcgaaattatcgaaagtttgcgcggacacacctcgggctatgcagttcctacctttgtggtacatgctccggggggtggtggtaagatacctgtagcgccgaactatgttgtatctcagtccccacgacacgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4158 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMRRLVHLLVKIRVRPYYIYACDLSLGIGHFRTPVSKGIEIIESLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4159 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaagtcatcaatcgtattaagacgctcgaccagctggagaagtacgttacactcaccgctgaagaagaagagggagtaaaagaatcgcccaaagtactccgaatggctatcacaccttattacttgagtttgatagaccccgagaatcctaattgtccgattcgtaaacaagccattcctactaaacgggaactggtacgtgctcctgaagatatggtagacccacttagtgaagatgaggattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttactatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgcccttactatatatatgcttgcgatctttcgcttggaatagggcatttccgcacgccggtatctaagggaatcgaagttatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4160 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEVIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4161 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcaccgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagaggaggcttgtgaaagaatggccaatgccggtattccgttgggtaaccaaacggttttattgcgtggaatcaatgattgtacacatgtgatgaagagattggtacatttgctggtaaagattcgtgtgcgcccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggaggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4162 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERTDRCIEYIANTPTVRDVLLSGGDALLVSDERLEYILKRLREVPHVEIVRIGSRAPVVLPQRITPQLVDMLKKYHPVWLNTHFNHPNEVTEEAEEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4163 - DNA, 1251 bp, Artificial Sequence
  Description of Artificial Sequence: Synthetic Construct
atggcagaaagtcgtagaaagcattatttccctgatgtcaccgatgggcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgatacgtaaacaagccattcctactaaacgggaactggtacgtgctcctgaagatatggtagacccacttagtgaagatgaagattcgcccgtacccggactgactcatcgttacccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatgcaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaagttatcgaaaatttgcgcggacacacctcgggctatgcagttcctacctttgtggtacatgctccggggggtggaggtaagatacctgtagcgccgaactatgttgtatctcagtccccacgacatgtggttcttcgcaattatgaaggtgttatcacaacctatacggagccggaggactatcatgaggagtgcgactgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4164 - protein, 416 aa, Artificial Sequence
  Description of Artificial Sequence: Synthetic Construct
MAESRRKHYFPDVTDGQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANAPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEVIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4165 - DNA, 1251 bp, Artificial Sequence
  Description of Artificial Sequence: Synthetic Construct
atggcagaaagtcgtagaatgcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattacttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttacccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgcccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaggcatcgtgagggcgtggctgcactttccggaggtcagcagttggctttagagcctcccgacttagctcgcaaagaacgcaggagcgataagaactaa

SEQ ID NO: 4166 - protein, 416 aa, Artificial Sequence
  Description of Artificial Sequence: Synthetic Construct
MAESRRMHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDRHREGVAALSGGQQLALEPPDLARKERRSDKN

SEQ ID NO: 4167 - DNA, 1251 bp, Artificial Sequence
  Description of Artificial Sequence: Synthetic Construct
atggcagaaagtcgtagaatgcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgcccttactatatatatgcttgcgatctttcgcttggaatagggcatttccgcacgccggtatctaagggaatcgaagttatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgactgtgaggactgccgagtcgacaggcatcgtgagggcgtggctgcactttccggaggtcagcagttggctttagagcctcccgacttagctcgcaaagaacgcaggagcgataagaactaa

SEQ ID NO: 4168 - protein, 416 aa, Artificial Sequence
  Description of Artificial Sequence: Synthetic Construct
MAESRRMHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEVIENLRGHTSGYAVPTFVVHAPGGGGKIPVAPNYVVSQSPRHVVLRNYEGVITTYTEPEDYHEECDCEDCRVDRHREGVAALSGGQQLALEPPDLARKERRSDKN

SEQ ID NO: 4169 - DNA, 1251 bp, Artificial Sequence
  Description of Artificial Sequence: Synthetic Construct
atggcagaaagtcgtagaatgcattatttccctgatgtcaccgatgagcaatggtacgactggcattggcaggtcatcaatcgtattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattaaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagaggaggcttgtgaaagaatggccaatgccggtattccgttgggtaaccaaacggttttattgcgtggaatcaatgattgtacacatgtgatgaagagattggtacatttgctggtaaagattcgtgtgcgcccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttctacgcaattatgaaggtgttatcacaacctatacggagccggaggactatcatgaggagtgcgattgtgaggactgccgagtcgacaggcatcgtgagggcgtggctgcactttccggaggtcagcagttggctttagagcctcccgacttagctcgcaaagaacgcaggagcgataagaactaa

SEQ ID NO: 4170 - protein, 416 aa, Artificial Sequence
  Description of Artificial Sequence: Synthetic Construct
MAESRRMHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAEEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDRHREGVAALSGGQQLALEPPDLARKERRSDKN

SEQ ID NO: 4171 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccggatggctatcacaccttattacttgagtttgatagaccccgagaatcctaattgtccgattcgtaaacaagccattcctactaaacgggaactggtacgtgctcctgaagatatggtagacccacttagtgaagatgaggattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatgcaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagaggaggcttgtgaaagaatggccaatgccggtattccattgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggtgggtggaggtaagatacctgtagcgccgaactatgttgtatctcagtccccacgacatgtggttcttcgcaattatgaaggtgttgtcacaacctatacggagccggaggactatcatgaggagtgcgactgtgaggactgccgagtcgacaggcatcgtgagggcgtggctgcactttccggaggtcagcagttggctttagagcctcccgacttagctcgcaaagaacgcaggagcgataagaactaa

SEQ ID NO: 4172 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANAPTVRDVLLSGGDALLVSDERLEYILKRLREVPHVEIVRIGSRAPVVLPQRITPQLVDMLKKYHPVWLNTHFNHPNEVTEEAEEACERMANAGIPLGNQTVLLRGINDCTHVMKRLVHLLVKIRVRPYYIYACDLSLGIGHFRTPVSKGIEIIENLRGHTSGYAVPTFVVHAPVGGGKIPVAPNYVVSQSPRHVVLRNYEGVVTTYTEPEDYHEECDCEDCRVDRHREGVAALSGGQQLALEPPDLARKERRSDKN

SEQ ID NO: 4173 - DNA, 1251 bp, Artificial Sequence
  Description of Artificial Sequence: Synthetic Construct
atggcagaaagtcgtagaatgcattatttccctgatgtcaccgatgagcaatggtacgactggcattggcaggtcatcaatcgtattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgatacgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaagttatcgaaaatttgcgcggacacacctcgggctatgcagttcctacctttgtggtacatgctccggtgggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaggcatcgtgagggcgtggctgcactttccggaggtcagcagttggctttagagcctcccgacttagctcgcaaagaacgcaggggcgataagaactaa

SEQ ID NO: 4174 - protein, 416 aa, Artificial Sequence
  Description of Artificial Sequence: Synthetic Construct
MAESRRMHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEVIENLRGHTSGYAVPTFVVHAPVGGGKIPVAPNYVVSQSPRHVVLRNYEGVITTYTEPEDYHEECDCEDCRVDRHREGVAALSGGQQLALEPPDLARKERRGDKN

SEQ ID NO: 4175 - DNA, 1251 bp, Artificial Sequence
  Description of Artificial Sequence: Synthetic Construct
atggcagaaagtcgtagaatgcattatttccctgatgtcaccgatgagcaatggtacgactggcattggcaggtcatcaatcgaattaagacgctcgaccagctggagaagtacgttacactcactgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggtgttattgcgtggaatcaatgattgtacacatgtgatgaagagattggtacatttgctggtaaagattcgtgtgcgcccttactatatatatgcttgcgatctttcgcttggaatagggcatttccgcacgccggtatctaagggaatcgaagttatcgaaaatttgcgcggacacacctcgggctatgcagttcctacctttgtggtacatgctccggggggtggaggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4176 - protein, 416 aa, Artificial Sequence
  Description of Artificial Sequence: Synthetic Construct
MAESRRMHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEVIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4177 - DNA, 1251 bp, Artificial Sequence
  Description of Artificial Sequence: Synthetic Construct
atggcagaaagtcgtagaatgcattatttccctgatgtcaccgatgagcaatggtacgactggcattggcaggtcatcaatcgtattaagacgctcgaccagctggagaagtacgttacactcaccgctgaagaagaagagggagtaaaagaatcgcccaaagtactccgaatggctatcacaccttattatttgagtttgatggaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaagttatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgactgtgaggactgccgagtcgacaggcatcgtgagggcgtggctgcactttccggaggtcagcagttggctttagagcctcccgacttagctcgcaaagaacgcaggagcgataggaactaa

SEQ ID NO: 4178 - protein, 416 aa, Artificial Sequence
  Description of Artificial Sequence: Synthetic Construct
MAESRRMHYFPDVTDEQWYDWHWQVINRIKTLDQLEKYVTLTAEEEEGVKESPKVLRMAITPYYLSLMDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEVIENLRGHTSGYAVPTFVVHAPGGGGKIPVAPNYVVSQSPRHVVLRNYEGVITTYTEPEDYHEECDCEDCRVDRHREGVAALSGGQQLALEPPDLARKERRSDRN

SEQ ID NO: 4179 - DNA, 1251 bp, Artificial Sequence
  Description of Artificial Sequence: Synthetic Construct
atggcagaaagtcgtagaaagcattatttccctgatgtcaccgatgggcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgatacgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatgcaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaagttatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgactgtgaggactgccgagtcgacaggcatcgtgagggcgtggctgcactttccggaggtcagcagttggctttagagcctcccgacttagctcgcaaagaacgcaggagcgataagaactaa

SEQ ID NO: 4180 - protein, 416 aa, Artificial Sequence
  Description of Artificial Sequence: Synthetic Construct
MAESRRKHYFPDVTDGQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANAPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEVIENLRGHTSGYAVPTFVVHAPGGGGKIPVAPNYVVSQSPRHVVLRNYEGVITTYTEPEDYHEECDCEDCRVDRHREGVAALSGGQQLALEPPDLARKERRSDKN

SEQ ID NO: 4181 - DNA, 1251 bp, Artificial Sequence
  Description of Artificial Sequence: Synthetic Construct
atggcagaaagtcgtagaaagcattatttccctgatgtcaccgatgggcaatggtacgactggcattggcaggtcatcaatcgtattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgatacgtaaacaagccattcctactaaacgggaactggtacgtgctcctgaagatatggtagacccacttagtgaagatgaagattcgcccgtacccggactgactcatcgttacccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatgcaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgcccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4182 - protein, 416 aa, Artificial Sequence
  Description of Artificial Sequence: Synthetic Construct
MAESRRKHYFPDVTDGQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANAPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4183 - DNA, 1251 bp, Artificial Sequence
  Description of Artificial Sequence: Synthetic Construct
atggcagaaagtcgtagaatgcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgatacgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagcccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagaggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgactgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4184 - protein, 416 aa, Artificial Sequence
  Description of Artificial Sequence: Synthetic Construct
MAESRRMHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTARDVLLSGGDALLVSDERLEYILKRLREVPHVEIVRIGSRAPVVLPQRITPQLVDMLKKYHPVWLNTHFNHPNEVTEEAEEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4185 - DNA, 1251 bp, Artificial Sequence
  Description of Artificial Sequence: Synthetic Construct
atggcagaaagtcgtagaaagcattatttccctgatgtcaccgatgggcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattaaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagaggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaagttatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgactgtgaggactgccgagtcgacaggcatcgtgagggcgtggctgcactttccggaggtcagcagttggctttagagcctcccgacttagctcgcaaagaacgcaggagcgataagaactaa

SEQ ID NO: 4186 - protein, 416 aa, Artificial Sequence
  Description of Artificial Sequence: Synthetic Construct
MAESRRKHYFPDVTDGQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAEEACERMANAGIPLGNQTVLLRGINDCTHVMKRLVHLLVKIRVRPYYIYACDLSLGIGHFRTPVSKGIEVIENLRGHTSGYAVPTFVVHAPGGGGKIPVAPNYVVSQSPRHVVLRNYEGVITTYTEPEDYHEECDCEDCRVDRHREGVAALSGGQQLALEPPDLARKERRSDKN

SEQ ID NO: 4187 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgtattaagacgctcgaccagctggagaagtacgttacactcaccgctgaagaggaagagggagtaaaagaatcgcccaaagtactccgaatggctatcacaccttattatttgagtttgatagaccccgagaatcctaattgtccgatacgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaagttatcgaaaatttgcgcggacacacctcgggctatgcagttcctaactttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactatccggaggtcagcagttggctttagagcctcccgacttagctcgcaaagaacgcaggagcgataagaactaa

SEQ ID NO: 4188 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEVIENLRGHTSGYAVPNFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4189 - DNA, 1251 bp, Artificial Sequence
  Description of Artificial Sequence: Synthetic Construct
atggcagaaagtcgtagaatgcattatttccctgatgtcaccgatgggcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaagttatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaggcatcgtgagggcgtggctgcactttccggaggtcagcagttggctttagagcctcccgacttagctcgcaaagaacgcaggagcgataagaactaa

SEQ ID NO: 4190 - protein, 416 aa, Artificial Sequence
  Description of Artificial Sequence: Synthetic Construct
MAESRRMHYFPDVTDGQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEVIENLRGHTSGYAVPTFVVHAPGGGGKIPVAPNYVVSQSPRHVVLRNYEGVITTYTEPEDYHEECDCEDCRVDRHREGVAALSGGQQLALEPPDLARKERRSDKN

SEQ ID NO: 4191 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattacttgagtttgatagaccccgagaatcctaattgtccgatacgtaaacaagccattcctactaaacgggaactggtacgtgctcctgaagatatggtagacccacttagtgaagatgaagattcgcccgtacccggactgactcatcgttacccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgtgcgccggtagtcctccctcagcgtataacgcctcaattggtggatatgctcaaaaaatatcatccggtgtggctgaacactcacttcaaccacccgaatgaagttaccgaagaagcagaggaggcttgtgaaagaatggccaatgccggtattccgttgggtaaccaaacggttttattgcgtggaatcaatgattgtacacatgtgatgaagagattggtacatttgctggtaaagattcgtgtgcgcccttactatatatatgcttgcgatctttcgcttggaatagggcatttccgcacgccggtatctaagggaatcgaagttatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgactgtgaggactgccgagtcgacaggcatcgtgagggcgtggctgcactttccggaggtcagcagttggctttagagcctcccgacttagctcgcaaagaacgcaggagcgataagaactaa

SEQ ID NO: 4192 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAEEACERMANAGIPLGNQTVLLRGINDCTHVMKRLVHLLVKIRVRPYYIYACDLSLGIGHFRTPVSKGIEVIENLRGHTSGYAVPTFVVHAPGGGGKIPVAPNYVVSQSPRHVVLRNYEGVITTYTEPEDYHEECDCEDCRVDRHREGVAALSGGQQLALEPPDLARKERRSDKN

SEQ ID NO: 4193 - DNA, 1251 bp, Artificial Sequence
  Description of Artificial Sequence: Synthetic Construct
atggcagaaagtcgtagaatgcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaggattcgcccgtacccggactgactcatcgttacccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagaggaggcttgtgaaagaatggccaatgccggtattccgttgggtaaccaaacggttttattgcgtggaatcaatgattgtacacatgtgatgaagagattggtacatttgctggtaaagattcgtgtgcgcccttactatatatatgcttgcgatctttcgcttggaatagggcatttccgcacgccggtatctaagggaatcgaagttatcgaaaatttgcgcggacacacctcgggctatgcagttcctacctttgtggtacatgctccggtgggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4194 - protein, 416 aa, Artificial Sequence
  Description of Artificial Sequence: Synthetic Construct
MAESRRMHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAEEACERMANAGIPLGNQTVLLRGINDCTHVMKRLVHLLVKIRVRPYYIYACDLSLGIGHFRTPVSKGIEVIENLRGHTSGYAVPTFVVHAPVGGGKIPVAPNYVVSQSPRHVVLRNYEGVITTYTEPEDYHEECDCEDCRVDKHREGVAALSGGQQLALEPPDLARKERRSDKN

SEQ ID NO: 4195 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttactacttgagtttgatagaccccgagaatcctaattgtccgattcgtaaacaagccattcctactaaacgggaactggtacgtgctcctgaggatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatgcaccgacagtccgcgatgttttgctatcgggaggcgatgccctccttgtcagcgacgaacgcttggaatacatattgaagcgtctgcgcgaagtacctcatgtggagattgttcgtatagggagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgcccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgactgtgaggactgccgagtcgacaagcatcgtgagggcgtggctgcactatccggaggtcagcagttggctttagagcctcccgacttagctcgcaaagaacgcaggagcgataagaactaa

SEQ ID NO: 4196 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANAPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4197 - DNA, 1251 bp, Artificial Sequence
  Description of Artificial Sequence: Synthetic Construct
atggcagaaagtcgtagaatgcattatttccctgatgtcaccgatgagcaatggtacgactggcattggcaggtcatcaatcgtattaagacgctcgaccagctggagaagtacgttacactcaccgctgaagaagaagggggagtaaaagaatcgcccaaagtactccgaatggctatcacaccttattacttgagtttgatagaccccgagaatcctaattgtccgatacgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagaggaggcttgtgaaagaatggccaatgccggtattccgttgggtaaccaaacggttttattgcgtggaatcaatgattgtacacatgtgatgaagagattggtacatttgctggtaaagattcgtgtgcgcccttactatatatatgcttgcgatctttcgcttggaatagggcatttccgcacgccggtatctaagggaatcgaagttatcgaaaatttgcgcggacacacctcgggctatgcagttcctacctttgtggtacatgctccggggggcggtggtaagatacctgtagcgccgaactatgttgtatctcagtccccacgacatgtggttcttcgcaattatgaaggtgttatcacaacctatacggagccggaggactaccatgaggagtgcgactgtgaggactgccgagtcgacaggcatcgtgagggcgtggctgcactttccggaggtcagcagttggctttagagcctcccgacttagctcgcaaagaacgcaggagcgataagaactaa

SEQ ID NO: 4198 - protein, 416 aa, Artificial Sequence
  Description of Artificial Sequence: Synthetic Construct
MAESRRMHYFPDVTDEQWYDWHWQVINRIKTLDQLEKYVTLTAEEEGGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAEEACERMANAGIPLGNQTVLLRGINDCTHVMKRLVHLLVKIRVRPYYIYACDLSLGIGHFRTPVSKGIEVIENLRGHTSGYAVPTFVVHAPGGGGKIPVAPNYVVSQSPRHVVLRNYEGVITTYTEPEDYHEECDCEDCRVDRHREGVAALSGGQQLALEPPDLARKERRSDKN

SEQ ID NO: 4199 - DNA, 1251 bp, Artificial Sequence
  Description of Artificial Sequence: Synthetic Construct
atggcagaaagtcgtagaaagcattatttccctgatgtcaccgatgggcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgactgtgaggactgccgagtcgacaggcatcgtgagggcgtggctgcactttccggaggtcagcagttggctttagagcctcccgacttagctcgcaaagaacgcaggagcgataagaactaa

SEQ ID NO: 4200 - protein, 416 aa, Artificial Sequence
  Description of Artificial Sequence: Synthetic Construct
MAESRRKHYFPDVTDGQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDRHREGVAALSGGQQLALEPPDLARKERRSDKN

SEQ ID NO: 4201 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgtattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgatacgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctcctcctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgcccttactatatatatgcttgcgatctttcgcttggaatagggcatttccgcacgccggtatctaagggaatcgaagttatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgactgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4202 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPPERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEVIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4203 - DNA, 1251 bp, Artificial Sequence
  Description of Artificial Sequence: Synthetic Construct
atggcagaaagtcgtagaatgcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattacttgagtttgatagaccccgagaatcctaattgtccgattcgtaaacaagccattcctactaaacgggaactggtacgtgctcctgaagatatggtagacccacttagtgaagatgaggattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaagaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgcccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgactgtgaggactgccgagtcgacaagcatcgtgagggcgtggctgcactatccggaggtcagcagttggctttagagcctcccgacttagctcgcaaagaacgcaggagcgataagaactaa

SEQ ID NO: 4204 - protein, 416 aa, Artificial Sequence
  Description of Artificial Sequence: Synthetic Construct
MAESRRMHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4205 - DNA, 1251 bp, Artificial Sequence
  Description of Artificial Sequence: Synthetic Construct
atggcagaaagtcgtagaatgcattatttccctgatgtcaccgatgggcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagaggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaagttatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgactgtgaggactgccgagtcgacaggcatcgtgagggcgtggctgcactttccggaggtcagcagttggctttagagcctcccgacttagctcgcaaagaacgcaggagcgataagaactaa

SEQ ID NO: 4206 - protein, 416 aa, Artificial Sequence
  Description of Artificial Sequence: Synthetic Construct
MAESRRMHYFPDVTDGQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAEEACERMANAGIPLGNQTVLLRGINDCTHVMKRLVHLLVKIRVRPYYIYACDLSLGIGHFRTPVSKGIEVIENLRGHTSGYAVPTFVVHAPGGGGKIPVAPNYVVSQSPRHVVLRNYEGVITTYTEPEDYHEECDCEDCRVDRHREGVAALSGGQQLALEPPDLARKERRSDKN

SEQ ID NO: 4207 - DNA, 1251 bp, Artificial Sequence
  Description of Artificial Sequence: Synthetic Construct
atggcagaaagtcgtagaatgcattatttccctgatgtcaccgatgggcaatggtacgactggcattggcaggtcatcaatcgaattaagacgctcgaccagctggagaagtacgttacactcaccgctgaagaagaagagggagtaaaagagtcgcccaaagtactccgaatggctatcacaccttattatttgagtttgatagaccccgagaatcctaattgtccgatacgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgcccttactatatatatgcttgcgatctttcgcttggaatagggcatttccgcacgccggtatctaagggaatcgaaattatcgaaaatttgcgcggacacacctcgggctatgcagttcctacctttgtggtacatgctccggtgggcggaggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaggcatcgtgagggcgtggctgcactttccggaggtcagcagttggctttagagcctcccgacttagctcgcaaagaacgcaggagcgataagaactaa

SEQ ID NO: 4208 - protein, 416 aa, Artificial Sequence
  Description of Artificial Sequence: Synthetic Construct
MAESRRMHYFPDVTDGQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPVGGGKIPVAPNYVVSQSPRHVVLRNYEGVITTYTEPEDYHEECDCEDCRVDRHREGVAALSGGQQLALEPPDLARKERRSDKN

SEQ ID NO: 4209 - DNA, 1251 bp, Artificial Sequence
  Description of Artificial Sequence: Synthetic Construct
atggcagaaagtcgtagaatgcattatttccctgatgtcaccgatgggcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttacccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattaaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagaggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4210 - protein, 416 aa, Artificial Sequence
  Description of Artificial Sequence: Synthetic Construct
MAESRRMHYFPDVTDGQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAEEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4211 - DNA, 1251 bp, Artificial Sequence
  Description of Artificial Sequence: Synthetic Construct
atggcagaaagtcgtagaatgcattatttccctgatgtcaccgatgggcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattaaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagaggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaagttatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataggaactaa

SEQ ID NO: 4212 - protein, 416 aa, Artificial Sequence
  Description of Artificial Sequence: Synthetic Construct
MAESRRMHYFPDVTDGQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAEEACERMANAGIPLGNQTVLLRGINDCTHVMKRLVHLLVKIRVRPYYIYACDLSLGIGHFRTPVSKGIEVIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDRN

SEQ ID NO: 4213 - DNA, 1251 bp, Artificial Sequence
  Description of Artificial Sequence: Synthetic Construct
atggcagaaagtcgtagaatgcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaggattcgcccgtacccggactgactcatcgttacccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatgcaccgacagtccgcgatgttttgctatcgggaggcgatgccctccttgtcagcgacgaacgcttggaatacatattaaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgcccttactatatatatgcttgcgatctttcgcttggaatagggcatttccgcacgccggtatctaagggaatcgaaattgtcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaggcatcgtgagggcgtggctgcactttccggaggtcagcagttggctttagagcctcccgacttagctcgcaaagaacgcaggagcgataagaactaa

SEQ ID NO: 4214 - protein, 416 aa, Artificial Sequence
  Description of Artificial Sequence: Synthetic Construct
MAESRRMHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANAPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIVENLRGHTSGYAVPTFVVHAPGGGGKIPVAPNYVVSQSPRHVVLRNYEGVITTYTEPEDYHEECDCEDCRVDRHREGVAALSGGQQLALEPPDLARKERRSDKN

SEQ ID NO: 4215 - DNA, 1251 bp, Artificial Sequence
  Description of Artificial Sequence: Synthetic Construct
atggcagaaagtcgtagaatgcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaggattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgcccttactatatatatgcttgcgatctttcgcttggaatagggcatttccgcacgccggtatctaagggaatcgaagttatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4216 - protein, 416 aa, Artificial Sequence; identical to SEQ ID NO: 4176
  Description of Artificial Sequence: Synthetic Construct

SEQ ID NO: 4217 - DNA, 1251 bp, Artificial Sequence
  Description of Artificial Sequence: Synthetic Construct
atggcagaaagtcgtagaatgcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgcccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaggcatcgtgagggcgtggctgcactttccggaggtcagcagttggctttagagcctcccgacttagctcgcaaagaacgcaggagcgataagaactaa

SEQ ID NO: 4218 - protein, 416 aa, Artificial Sequence; identical to SEQ ID NO: 4166
  Description of Artificial Sequence: Synthetic Construct

SEQ ID NO: 4219 - DNA, 1251 bp, Artificial Sequence
  Description of Artificial Sequence: Synthetic Construct
atggcagaaagtcgtagaatgcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttacccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgcccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4220 - protein, 416 aa, Artificial Sequence; identical to SEQ ID NO: 4204
  Description of Artificial Sequence: Synthetic Construct

SEQ ID NO: 4221 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaggattcgcccgtacccggactgactcatcgttacccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcggtaagaactaa

SEQ ID NO: 4222 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSGKN

SEQ ID NO: 4223 - DNA, 1251 bp, Artificial Sequence
  Description of Artificial Sequence: Synthetic Construct
atggcagaaagtcgtagaatgcattatttccctgatgtcaccgatgagcaatggtacgactggcattggcaggtcatcaatcgtattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatgcaccgacagtccgcgatgttttgctatcgggaggcgatgccctccttgtcagcgacgaacgcttggaatacatattaaagcgtctgcgcgaagtacctcatgtggagattgttcgtatagggagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaggcatcgtgagggcgtggctgcactttccggaggtcagcagttggctctagagcctcccgacttagctcgcaaagaacgcaggagcgataagaactaa

SEQ ID NO: 4224 - protein, 416 aa, Artificial Sequence
  Description of Artificial Sequence: Synthetic Construct
MAESRRMHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANAPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDRHREGVAALSGGQQLALEPPDLARKERRSDKN

SEQ ID NO: 4225 - DNA, 1251 bp, Artificial Sequence
  Description of Artificial Sequence: Synthetic Construct
atggcagaaagtcgtagaatgcattatttccctgatgtcaccgatgagcaatggtacgactggcattggcaggtcatcaatcgaattaagacgctcgaccagctggagaagtacgttacactcaccgctgaagaagaagggggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaggattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggcacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggtaggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagccgacaagcatcgtgagggcgtggctgcactatccggaggtcagcagttggctttagagcctcccgacttagctcgcaaagaacgcaggagcgataagaactaa

SEQ ID NO: 4226 - protein, 416 aa, Artificial Sequence
  Description of Artificial Sequence: Synthetic Construct
MAESRRMHYFPDVTDEQWYDWHWQVINRIKTLDQLEKYVTLTAEEEGGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLAHLLVKIRVRPYYIYACDLSLGIGHFRTPVSKGIEIIENLRGHTSGYAVPTFVVHAPVGGGKIPVAPNYVVSQSPRHVVLRNYEGVITTYTEPEDYHEECDCEDCRADKHREGVAALSGGQQLALEPPDLARKERRSDKN

SEQ ID NO: 4227 - DNA, 1251 bp, Artificial Sequence
  Description of Artificial Sequence: Synthetic Construct
atggcagaaagtcgtagaaagcattatttccctgatgtcaccgatgggcaatggtacgactggcattggcaggtcatcaatcgtattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttacccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgcccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacgacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4228 - protein, 416 aa, Artificial Sequence
  Description of Artificial Sequence: Synthetic Construct
MAESRRKHYFPDVTDGQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4229 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgccgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatgcaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaagttatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgactgtgaggactgccgagtcgacaggcatcgtgagggcgtggctgcactatccggaggtcagcagttggctttagagcctcccgtcttagctcgcaaagaacgcaggagcgataagaactaa

SEQ ID NO: 4230 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANAPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEVIENLRGHTSGYAVPTFVVHAPGGGGKIPVAPNYVVSQSPRHVVLRNYEGVITTYTEPEDYHEECDCEDCRVDRHREGVAALSGGQQLALEPPVLARKERRSDKN

SEQ ID NO: 4231 - DNA, 1251 bp, Artificial Sequence
  Description of Artificial Sequence: Synthetic Construct
atggcagaaagtcgtagaatgcattatttccctgatgtcaccgatgggcaatggtacgactggcattggcaggtcatcaatcgtattaagacgctcgaccagctggagaagtacgttacactcaccgctgaagaagaagagggagtaaaagaatcgcccaaagtactccgaatggctatcacaccttattacttgagtttgatagaccccgagaatcctaattgtccgatacgtaaacaagccattcctactaaacgggaactggtacgtgctcctgaagatatggtagacccacttagtgaagatgaggattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaagttatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4232 - protein, 416 aa, Artificial Sequence
  Description of Artificial Sequence: Synthetic Construct
MAESRRMHYFPDVTDGQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEVIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4233 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcgtggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgcccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgactgtgaagactgccgagtcgacaggcatcgtgagggcgtggctgcactttccggaggtcagcagttggctttagagcctcccgacttagctcgcaaagaacgcaggagcgataagaactaa

SEQ ID NO: 4234 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERVEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDRHREGVAALSGGQQLALEPPDLARKERRSDKN

SEQ ID NO: 4235 - DNA, 1251 bp, Artificial Sequence
  Description of Artificial Sequence: Synthetic Construct
atggcagaaagtcgtagaatgcattatttccctgatgtcactgatgggcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattacttgagtttgatagaccccgagaatcctaattgtccgatacgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgcccttactatatatatgcttgcgatctttcgcttggaatagggcatttccgcacgccggtatctaagggaatcgaagttatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgactgtgaggactgccgagtcgacaagcatcgtgagggcgtggctgcactttccggaggtcagcagttggcttcagagcctcccgacttagctcgcaaagaacgcaggagcgataagaactaa

SEQ ID NO: 4236 - protein, 416 aa, Artificial Sequence
  Description of Artificial Sequence: Synthetic Construct
MAESRRMHYFPDVTDGQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEVIENLRGHTSGYAVPTFVVHAPGGGGKIPVAPNYVVSQSPRHVVLRNYEGVITTYTEPEDYHEECDCEDCRVDKHREGVAALSGGQQLASEPPDLARKERRSDKN

SEQ ID NO: 4237 - DNA, 1251 bp, Artificial Sequence
  Description of Artificial Sequence: Synthetic Construct
atggcagaaagtcgtagaatgcattatttccctgatgtcaccgatgagcaatggtacgactggcattggcaggtcatcaatcgtattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgatacgtaaacaagccattcctactaaacgggaactggtacgtgctcctgaagatatggtagacccacttagagaagatgaagattcgcccgtacccggactgactcatcgttacccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgcataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgcccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactatccggaggtcagcagttggctttagagcctcccgacttagctcgcaaagaacgcaggagcgataagaactaa

SEQ ID NO: 4238 - protein, 416 aa, Artificial Sequence
  Description of Artificial Sequence: Synthetic Construct
MAESRRMHYFPDVTDEQWYDWHWQVINRIKTLDQLEKYVTLTAEEEEGVKESPKVLRMAITPYYLSLIDPENPNCPIRKQAIPTKRELVRAPEDMVDPLREDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4239 - DNA, 1251 bp, Artificial Sequence
  Description of Artificial Sequence: Synthetic Construct
atggcagaaagtcgtagaatgcattatttccctgatgtcaccgatgagcaatggtacgactggcattggcaggtcatcaatcgaattaagacgctcgaccagctggagaagtacgttacactcaccgctgaagaagaagggggagtaaaagaatcgcccaaagtactccgaatggctatcacaccttattatttgagtttgatagaccccgagaatcctaattgtccgatacgtaaacaagccattcctactaaacgggaactggtacgtgctcctgaagatatggtagacccacttagtgaagatgaggattcgcccgtacccggactgactcatcgttacccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattaaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagaggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaagttatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgactgtgaggactgccgagtcgacaagcatcgtgagggcgtggctgcactatccggaggtcagcagttggctttagagcctcccgacttagctcgcaaagaacgcaggagcgataagaactaa

SEQ ID NO: 4240 - protein, 416 aa, Artificial Sequence
  Description of Artificial Sequence: Synthetic Construct
MAESRRMHYFPDVTDEQWYDWHWQVINRIKTLDQLEKYVTLTAEEEGGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAEEACERMANAGIPLGNQTVLLRGINDCTHVMKRLVHLLVKIRVRPYYIYACDLSLGIGHFRTPVSKGIEVIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4241 - DNA, 1251 bp, Artificial Sequence
  Description of Artificial Sequence: Synthetic Construct
atggcagaaagtcgtagaatgcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaggattcgcccgtacccggactgactcatcgttacccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatgcaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggcggtggtaagatacctgtagcgccgaactatgttgtatctcagtccccacgacatgtggttcttcgcaattatgaaggtgttatcacaacctatacggagccggaggactatcatgaggagtgcgactgtgaggactgccgagtcgacaggcatcgtgagggcgtggctgcactttccggaggtcagcagttggctttagagcctcccgacttagctcgcaaagaacgcaggagcgataagaactaa

SEQ ID NO: 4242 - protein, 416 aa, Artificial Sequence; identical to SEQ ID NO: 4224
  Description of Artificial Sequence: Synthetic Construct

SEQ ID NO: 4243 - DNA, 1251 bp, Artificial Sequence
  Description of Artificial Sequence: Synthetic Construct
atggcggaaagtcgtagaaagcattatttccctgatgtcaccgatgggcaatggtacgactggcattggcaggtcatcaatcgtattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgcccttactatatatatgcttgcgatctttcgcttggaatagggcatttccgcacgccggtatctaagggaatcgaagttatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaggcatcgtgagggcgtggctgcactttccggaggtcagcagttggctttagagcctcccgacttagctcgcaaagaacgcaggagcgataagaactaa

SEQ ID NO: 4244 - protein, 416 aa, Artificial Sequence
  Description of Artificial Sequence: Synthetic Construct
MAESRRKHYFPDVTDGQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEVIENLRGHTSGYAVPTFVVHAPGGGGKIPVAPNYVVSQSPRHVVLRNYEGVITTYTEPEDYHEECDCEDCRVDRHREGVAALSGGQQLALEPPDLARKERRSDKN

SEQ ID NO: 4245 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgatacgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagaggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4246 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAEEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4247 - DNA, 1251 bp, Artificial Sequence
  Description of Artificial Sequence: Synthetic Construct
atggcagaaagtcgtagaatgcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattacttgagtttgatagaccccgagaatcctaattgtccgattcgtaaacaagccattcctactaaacgggaactggtacgtgctcctgaagatatggtagacccacttagtgaagatgaggattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtatagggagccgtgcgccggtagtcctccctcagcgtataacgcctcaattggtggatatgctcaaaaaatatcatccggtgtggctgaacactcacttcaaccacccgaatgaagttaccgaagaagcagaggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaagttatcgaaaatttgcgcggacacacctcgggctatgcagttcctacctttgtggtacatgctccggggggcggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaggcatcgtgagggcgtggctgcactttccggaggtcagcagttggctttagagcctcccgacttagctcgcaaagaacgcaggagcgataagaactaa

SEQ ID NO: 4248 - protein, 416 aa, Artificial Sequence
  Description of Artificial Sequence: Synthetic Construct
MAESRRMHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAEEACERMANAGIPLGNQTVLLRGINDCTHVMKRLVHLLVKIRVRPYYIYACDLSLGIGHFRTPVSKGIEVIENLRGHTSGYAVPTFVVHAPGGGGKIPVAPNYVVSQSPRHVVLRNYEGVITTYTEPEDYHEECDCEDCRVDRHREGVAALSGGQQLALEPPDLARKERRSDKN

SEQ ID NO: 4249 - DNA, 1251 bp, Artificial Sequence
  Description of Artificial Sequence: Synthetic Construct
atggcagaaagtcgtagaatgcattatttccctgatgtcaccgatgagcaatggtacgactggcattggcaggtcatcaatcgtattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttacccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgcccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggcggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaggcatcgtgagggcgtggctgcactttccggaggtcagcagttggctttagagcctcccgacttagctcgcaaagaacgcaggagcgataagaactaa

SEQ ID NO: 4250 - protein, 416 aa, Artificial Sequence; identical to SEQ ID NO: 4166
  Description of Artificial Sequence: Synthetic Construct

SEQ ID NO: 4251 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4252 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRVDKHREGVAALSGGQQLALEPPDLARKERRSDKN

SEQ ID NO: 4253 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcgtgaggagtgcgattgtgaggactgccgagtcgacaagcataaagagggcgtggctgcactttccggaggtcagcagttggctttagagcctcccgacttagctcgcaaagaacgcaggagcgataagaactaa

SEQ ID NO: 4254 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYREECDCEDCRVDKHKEGVAALSGGQQLALEPPDLARKERRSDKN

SEQ ID NO: 4255 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4256 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRVDKHREGVAALSGGQQLALEPPDLARKERRSDKN

SEQ ID NO: 4257 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcataaagagggcgtggctgcactttccggaggtcagcagttggctttagagcctcccgacttagctcgcaaagaacgcaggagcgataagaactaa

SEQ ID NO: 4258 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHKEGVAALSGGQQLALEPPDLARKERRSDKN

SEQ ID NO: 4259 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagtcgacaagcataaagagggcgtggctgcactttccggaggtcagcagttggctttagagcctcccgacttagctcgcaaagaacgcaggagcgataagaactaa

SEQ ID NO: 4260 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRVDKHKEGVAALSGGQQLALEPPDLARKERRSDKN

SEQ ID NO: 4261 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgatcgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcataaagagggcgtggctgcactttccggaggtcagcagttggctttagagcctcccgacttagctcgcaaagaacgcaggagcgataagtactaa

SEQ ID NO: 4262 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDRTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHKEGVAALSGGQQLALEPPDLARKERRSDKY

SEQ ID NO: 4263 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaggaagagggagtaaaagaatcgcccaaagtactccgaatggctatcacaccttattatttgagtttgatagaccccgagaatcctaattgtccgattcgtaaacaagccattcctactaaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4264 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKQELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4265 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttgcactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacggagagatgcttcttctccttctgagcgcatcgatcggtgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgcggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaataggacatttccgcacgccggtatctaagggaatcgaaattatcgaaaatttgcgcggacacacctcgggctatgcagttcctacctttgtggtacatgctccggggggtggtggtaagatacctgtagcgccgagctatgtggtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4266 - protein, 416 aa, Artificial Sequence
  Description of Artificial Sequence: Synthetic Construct
MAESRRKHYFPDVTDEQWYDWHWQVINRIKTLDQLEKYVALTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGRRDASSPSERIDRCIEYIANTPTVRDVLLSGGDALLVSDERLEYILKRLREVPHVEIVRIGSRAPVVLPQRITPQLVDMLKKYHPVRLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPSYVVSQSPRHVVLRNYEGVITTYTEPEDYHEECDCEDCRVDKHREGVAALSGGQQLALEPPDLARKERRSDKN

SEQ ID NO: 4267 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttgcactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactaactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccccccttgtcagcgacgagcgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatctgctggtaaagattcgtgtgcgtccctactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccggactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4268 - protein, 416 aa, Artificial Sequence
  Description of Artificial Sequence: Synthetic Construct
MAESRRKHYFPDVTDEQWYDWHWQVINRIKTLDQLEKYVALTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDAPLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPDYVVSQSPRHVVLRNYEGVITTYTEPEDYHEECDCEDCRVDKHREGVAALSGGQQLALEPPDLARKERRSDKN

SEQ ID NO: 4269 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcggattaagacgctcgaccagctggagaagtacgttacactcaccgctgaagaagaagagggagtaaaagaatcgcccaaagtactccgaatggctatcacaccctattatttgagtttgatagaccccgagaatcctaattgtccgattcgtaaacaagccattcctactaaacgggaactggtacgtgctcctgaagatatggtagacccacttagtgaagatgaagattcgcccgtacccggactaactcatcgttatccggatcgcgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtgttccgttgggtaaccaaacggttttattgcgtggaatcaatgattgtacacatgtgatgaagagattggtacatttgctggtaaagattcgtgtgcgtccctactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaaggacgcaggagcgataagaactaa

SEQ ID NO: 4270 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGVPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKGRRSDKN

SEQ ID NO: 4271 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttgcactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacatgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaaggatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacgacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggcgcgataagaactaa

SEQ ID NO: 4272 - protein, 416 aa, Artificial Sequence
  Description of Artificial Sequence: Synthetic Construct
MAESRRKHYFPDVTDEQWYDWHWQVINRIKTLDQLEKYVALTAEEEEGVKESPKVLRMAITPYYLSLIDPENPNCPIRKQAIPTKRELVHAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRRDKN

SEQ ID NO: 4273 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagcaaaagaatcgcccaaagtactccgaatggctatcacaccttattatttgagtttgatagaccccgagaatcctaattgtccgattcgtaaacaagccattcctactaaacgggaactggtacatgctcctgaagatatggtagacccacttagtgaagatgaagattcgcccgtacccggactgactcatcgttatccggatcgcgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgtagaagcagtggaggcttgtgaaaggatggccaatgccggtgttccgttgggtaaccaaacggttttattgcgtggaatcaatgattgtacacatgtgatgaagcgattggtacatttgctggtaaagattcgtgtgcgtccttactatatatatgcttgcgatctttcgcttggaatagggcatttccgcacgccggtatctaagggaatcgaaattatcgagaatttgcgcggacacacctcgggctatgcagttcctacctttgtggtacatgctccggggggtggtggtaagatacctgtagcgccgagctatgtggtatctcagtccccacgtcatgtggttcttcgcaattatgaaggtgttatcacaacctatacggagccggaggactatcatgaggagtgcgattgtgaggactgccgtgtcgacaagcatcgtgagggcgtggctgcactttccggaggtcagcagttggctttagagcctcccgacttagctcgcaaagaacgcaggagcgataagaactaa

SEQ ID NO: 4274 - protein, 416 aa, Artificial Sequence
  Description of Artificial Sequence: Synthetic Construct
MAESRRKHYFPDVTDEQWYDWHWQVINRIKTLDQLEKYVTLTAEEEEGAKESPKVLRMAITPYYLSLIDPENPNCPIRKQAIPTKRELVHAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTVEAVEACERMANAGVPLGNQTVLLRGINDCTHVMKRLVHLLVKIRVRPYYIYACDLSLGIGHFRTPVSKGIEIIENLRGHTSGYAVPTFVVHAPGGGGKIPVAPSYVVSQSPRHVVLRNYEGVITTYTEPEDYHEECDCEDCRVDKHREGVAALSGGQQLALEPPDLARKERRSDKN

SEQ ID NO: 4275 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacggagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4276 - protein, 416 aa, Artificial Sequence; identical to SEQ ID NO: 3854
  Description of Artificial Sequence: Synthetic Construct

SEQ ID NO: 4277 - DNA, 1251 bp, Artificial Sequence
  Description of Artificial Sequence: Synthetic Construct
atggcagaaagtcgtagaatgcattatttccctgatgtcaccgatgggcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgaatttgatagaccccgagaatcctaattgtccgatacgtaaacaagccattcctactaaacgggaactggtacgtgctcctgaagatatggtagacccacttagtgaagatgaggattcgcccgtacccggactgactcatcgttacccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatgcaccgacagcccgcgatgttttgctatcgggaggcgatgccctccttgtcagcgacgaacgcttggaatacatattgaagcgtctgcgcgaagtacctcatgtggagactgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgcccttactatatatatgcttgcgatctttcgcttggaatagggcatttccgcacgccggtatctaagggaatcgaagttatcgaaaatttgcgcggacacacctcgggctatgcagttcctacctttgtggtacatgctccggggggcggaggtaagatacctgtagcgccgaactatgttgtatctcagtccccacgacatgtggttcttcgcaattatgaaggtgttatcacaacctatacggagccggaggactatcatgaggagtgcgactgtgaggactgccgagtcgacaggcatcgtgagggcgtggctgcactttccggaggtcagcagttggctttagagcctcccgacttagctcgcaaagaacgcaggagcgataagaactaa

SEQ ID NO: 4278 - protein, 416 aa, Artificial Sequence
  Description of Artificial Sequence: Synthetic Construct
MAESRRMHYFPDVTDGQWYDWHWQVINRIKTLDQLEKYVTLTAEEEEGVKESPKVLRMAITPYYLNLIDPENPNCPIRKQAIPTKRELVRAPEDMVDPLSEDEDSPVPGLTHRYPDRVLFLITDKCSMYCRHCTRRRFAGQRDASSPSERIDRCIEYIANAPTARDVLLSGGDALLVSDERLEYILKRLREVPHVETVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEVIENLRGHTSGYAVPTFVVHAPGGGGKIPVAPNYVVSQSPRHVVLRNYEGVITTYTEPEDYHEECDCEDCRVDRHREGVAALSGGQQLALEPPDLARKERRSDKN

SEQ ID NO: 4279 - DNA, 1251 bp, Artificial Sequence
  Description of Artificial Sequence: Synthetic Construct
atggcagaaagtcgtagaatgcattatttccctgatgtcaccgatgagcaacggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgcccttactatatatatgcttgcgatctttcgcttggaatagggcatttccgcacgccggtatctaagggaatcgaagttatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaggcatcgtgagggcgtggctgcactttccggaggtcagcagttggctttagagcctcccgacttagctcgcaaagaacgcaggagcgataagaactaa

SEQ ID NO: 4280 - protein, 416 aa, Artificial Sequence
  Description of Artificial Sequence: Synthetic Construct
MAESRRMHYFPDVTDEQRYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEVIENLRGHTSGYAVPTFVVHAPGGGGKIPVAPNYVVSQSPRHVVLRNYEGVITTYTEPEDYHEECDCEDCRVDRHREGVAALSGGQQLALEPPDLARKERRSDKN

SEQ ID NO: 4281 - DNA, 1251 bp, Artificial Sequence
  Description of Artificial Sequence: Synthetic Construct
atggcagaaagtcgtagaatgcattatttccctgatgtcaccgatgagcaatggtacgactggcattggcaggtcatcaatcgaattaagacgctcgaccagctggagaagtacgttacactcaccgctgaagaagaagggggagtaaaagaatcgcccaaagtactccgaatggctatcacaccttattatttgagtttgatagaccccgagaatcctaattgtccgatacgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatgcaccgacagtccgcgatgttttgctatcgggaggcgatgccctccttgtcagcgacgaacgcttggaatacatattaaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4282 - protein, 416 aa, Artificial Sequence
  Description of Artificial Sequence: Synthetic Construct
MAESRRMHYFPDVTDEQWYDWHWQVINRIKTLDQLEKYVTLTAEEEGGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANAPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4283 - DNA, 1251 bp, Artificial Sequence
  Description of Artificial Sequence: Synthetic Construct
atggcagaaagtcgtagaatgcattatttccctgatgtcaccgatgggcaatggtacgactggcattggcaggtcatcaatcgtattaagacgctcgaccagctggagaagtacgttacactcaccgccgaagaagaagggggagtaaaagaatcgcccaaagtactccgaatggctatcacaccttattacttgaatttgatagaccccgagaatcctaattgtccgattcgtaaacaagccattcctactaaacgggaactggtacgtgctcctgaagatatggtagacccacttagtgaagatgaggattcgcccatacccggactgactcatcgttacccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatgcaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagacctccctcagcgtataacgcctcaattggtggatatgctcaaaaaatatcatccggtgtggctgaacactcacttcaaccacccgaatgaagttaccgaagaagcagaggaggcttgtgaaagaatggccaatgccggtattccgttgggtaaccaaacggttttattgcgtggagtcaatgattgtacacatgtgatgaagagattggtacatttgctggtaaagattcgtgtgcgcccttactatatatatgcttgcgatctttcgcttggaatagggcatttccgcacgccggtatctaagggaatcgaagttatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaggcatcgtgagggcgtggctgcactatccggaggtcagcagttggctttagagcctcccgacttagctcgcaaagaacgcaggagcgataagaactaa

SEQ ID NO: 4284 - protein, 416 aa, Artificial Sequence
  Description of Artificial Sequence: Synthetic Construct
MAESRRMHYFPDVTDGQWYDWHWQVINRIKTLDQLEKYVTLTAEEEGGVKESPKVLRMAITPYYLNLIDPENPNCPIRKQAIPTKRELVRAPEDMVDPLSEDEDSPIPGLTHRYPDRVLFLITDKCSMYCRHCTRRRFAGQRDASSPSERIDRCIEYIANAPTVRDVLLSGGDALLVSDERLEYILKRLREVPHVEIVRIGSRAPVDLPQRITPQLVDMLKKYHPVWLNTHFNHPNEVTEEAEEACERMANAGIPLGNQTVLLRGVNDCTHVMKRLVHLLVKIRVRPYYIYACDLSLGIGHFRTPVSKGIEVIENLRGHTSGYAVPTFVVHAPGGGGKIPVAPNYVVSQSPRHVVLRNYEGVITTYTEPEDYHEECDCEDCRVDRHREGVAALSGGQQLALEPPDLARKERRSDKN

SEQ ID NO: 4285 - DNA, 1251 bp, Artificial Sequence
  Description of Artificial Sequence: Synthetic Construct
atggcagaaagtcgtagaaagcattatttccctgatgtcaccgatgggcaatggtacgactggcattggcaggtcatcaatcgaattaagacgctcgaccagctggagaagtacgttacactcaccgttgaagaagaagagggagtaaaagaatcgcccaaagtactccgaatggctatcacaccttattatttgagtttgatagaccccgagaatcctaattgtccgatacgtaaacaagccattcctactaaacgggaactggtacgtgctcctgaagataaggtagacccacttagtgaagatgaggattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgctcggaatacatattgaagcgtctgcgcgaagtacctcatgtggagattgttcgtatagggagccgtgcgccggtagtcctccctcagcgtataacgcctcaattggtggatatgctcaaaaaatatcatccggtgtggctgaacactcacttcaaccacccgaatgaagttaccgaagaagcagaggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaagttatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgactgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4286 - protein, 416 aa, Artificial Sequence
  Description of Artificial Sequence: Synthetic Construct
MAESRRKHYFPDVTDGQWYDWHWQVINRIKTLDQLEKYVTLTVEEEEGVKESPKVLRMAITPYYLSLIDPENPNCPIRKQAIPTKRELVRAPEDKVDPLSEDEDSPVPGLTHRYPDRVLFLITDKCSMYCRHCTRRRFAGQRDASSPSERIDRCIEYIANTPTVRDVLLSGGDALLVSDERSEYILKRLREVPHVEIVRIGSRAPVVLPQRITPQLVDMLKKYHPVWLNTHFNHPNEVTEEAEEACERMANAGIPLGNQTVLLRGINDCTHVMKRLVHLLVKIRVRPYYIYACDLSLGIGHFRTPVSKGIEVIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4287 - DNA, 1251 bp, Artificial Sequence
  Description of Artificial Sequence: Synthetic Construct
atggcaaaaagtcggagaatgcattatttccctgatgtcacccatgagcaagggtacgactggcatgggcaggccgtcattcgaattaagacgctcgaccagctggagaagtacgttacactcaccgatgaagaagaagagggagtaaaagaatcgcccaaagtactccgaatggctatcacaccttattatttgagtttgatagaccccgagaatcttaattgtccgatacgtaaacaagccattcctactaaacgggaactggtacgtgctcctgaagatatggtagacccacttagtgaagatgaggattcgcccgtacccggactgactcatcgttatccggatcgtgtattgttccttatcacggacaaatgttcgatgtactgtcgtcattgtactcgccgtcgcttcgcaggacagggagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagaggaggcttgtgaaagaatggccaatgccggtattccgttgggtaaccaaacggttttattgcgtggaatcaatgattgtacacatgcgatgaagagattggtacatttgctggtaaagattcgtgtgcgcccttactatatatatgcttgcgatctttcgcttggaatagggcatttccgcacgccggtatctaagggaatcgaagttatcgaaaatttgcgcggacacacctcgggctatgcagttcctacctttgtggtacatgctccggggggtggaggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagagctaa

SEQ ID NO: 4288 - protein, 416 aa, Artificial Sequence
  Description of Artificial Sequence: Synthetic Construct
MAKSRRMHYFPDVTHEQGYDWHGQAVIRIKTLDQLEKYVTLTDEEEEGVKESPKVLRMAITPYYLSLIDPENLNCPIRKQAIPTKRELVRAPEDMVDPLSEDEDSPVPGLTHRYPDRVLFLITDKCSMYCRHCTRRRFAGQGDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAEEACERMANAGIPLGNQTVLLRGINDCTHAMKRLVHLLVKIRVRPYYIYACDLSLGIGHFRTPVSKGIEVIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKS

SEQ ID NO: 4289 - DNA, 1251 bp, Artificial Sequence
  Description of Artificial Sequence: Synthetic Construct
atggcagaaagtcgtagaatgcattatttccctgatgtcaccgatgagcaatggtacgactggcattggcaggtcatcaatcgtattaagacgctcgaccagctggagaagtacgttacactcaccgctgaagaagaagagggagtaaaagaatcgcccaaagtactccgaatggctatcacaccttattacttgagtttgatagaccccgagaatcctaattgtccgatacgtaaacaagccattcctactaaacgggaactggtacgtgctcctgaagatatggtagacccacttagtgaagatgaagattcgcccgtacccggactgactcatcgttacccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatgcaccgacagcccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgcccttactatatatatgcttgcgatctttcgcttggaatagggcatttccgcacgccggtatctaagggaatcgaagttatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4290 - protein, 416 aa, Artificial Sequence
  Description of Artificial Sequence: Synthetic Construct
MAESRRMHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANAPTARDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEVIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4291 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagcactccgaatggctatcacaccttattatttgagtttgatagaccccgagaatcctaattgtccgattcgtaaacaagccattcctactaaacgggaactggtacgtgctcctgaagatatggcagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4292 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKALRMAITPYYLSLIDPENPNCPIRKQAIPTKRELVRAPEDMADPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRVDKHREGVAALSGGQQLALEPPDLARKERRSDKN

SEQ ID NO: 4293 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggtctatcatgaggagtgcgattgtgaggactgccgagccgacaagcatcgtgagggcgtggctgcactttccggaggtcagcagttggctttagagcctcccgacttagctcgcaaagaacgcaggagcgataagaactaa

SEQ ID NO: 4294 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEVYHEECDCEDCRADKHREGVAALSGGQQLALEPPDLARKERRSDKN

SEQ ID NO: 4295 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtggaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctctcgcttggaatagggcatttccgcacgccggtatctaagggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaagaacgcaggagcgataagaactaa

SEQ ID NO: 4296 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACGRMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKERRSDKN

SEQ ID NO: 4297 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcatcgtgagggcgtggctgcactttccggaggtcagcagttggctttagagcctcccgacttagctcgcaaagaacgcaggagcgataagaactaa

SEQ ID NO: 4298 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHREGVAALSGGQQLALEPPDLARKERRSDKN

SEQ ID NO: 4299 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagccgacaagcatcgtgagggcgtggctgcactttccggaggtcagcagttggctttagagcctcccgacttagctcgcaaagaacgcaggagcgataagaactaa

SEQ ID NO: 4300 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRADKHREGVAALSGGQQLALEPPDLARKERRSDKN

SEQ ID NO: 4301 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgccagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcataaagagggcgtggctgcactttccggaggtcagcagttggctttagagcctcccgacttagctcgcaaagaacgcaggagcgataagaactaa

SEQ ID NO: 4302 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQRDASSPSERIDRCIEYIANTPTVRDVLLSGGDALLASDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHKEGVAALSGGQQLALEPPDLARKERRSDKN

SEQ ID NO: 4303 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggcggtaagatacctgtaacgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4304 - protein, 416 aa, Artificial Sequence; identical to SEQ ID NO: 4256
  Description of Artificial Sequence: Synthetic Construct

SEQ ID NO: 4305 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagtcgacaagcataaagagggcgtggctgcactttccggaggtcagcagttggctttagagcctcccgacttagctcgcaaagaacgcaggagcgataagaactaa

SEQ ID NO: 4306 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRVDKHKEGVAALSGGQQLALEPPDLARKERRSDKN

SEQ ID NO: 4307 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtagttcttcgcaattatgaaggtgttatcacaacctatacggagccggaggactatcatgaggagtgcgattgtgaggactgccgagccgacaagcatcgtgagggcgtggctgcactttccggaggtcagcagttggctttagagcctcccgacttagctcgcaaagaacgcaggagcgataagaactaa

SEQ ID NO: 4308 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRADKHREGVAALSGGQQLALEPPDLARKERRSDKN

SEQ ID NO: 4309 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacgccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcatcgtgagggcgtggctgcactttccggaggtcagcagttggctttagagcctcccgacttagctcgcaaagaacgcaggagcgataagaactaa

SEQ ID NO: 4310 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHREGVAALSGGQQLALEPPDLARKERRSDKN

SEQ ID NO: 4311 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacacccacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4312 - protein, 416 aa, Artificial Sequence; identical to SEQ ID NO: 4256
  Description of Artificial Sequence: Synthetic Construct

SEQ ID NO: 4313 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4314 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRVDKHREGVAALSGGQQLALEPPDLARKERRSDKN

SEQ ID NO: 4315 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagtcgacaagcataaagagggcgtggctgcactttccggaggtcagcagttggctttagagcctcccgacttagctcgcaaagaacgcaggagcgataagaactaa

SEQ ID NO: 4316 - protein, 416 aa, Artificial Sequence; identical to SEQ ID NO: 3658
  Description of Artificial Sequence: Synthetic Construct

SEQ ID NO: 4317 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagttggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacggaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4318 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGRKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRVDKHREGVAALSGGQQLALEPPDLARKERRSDKN

SEQ ID NO: 4319 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccgggctgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggtgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4320 - protein, 416 aa, Artificial Sequence; identical to SEQ ID NO: 3260
  Description of Artificial Sequence: Synthetic Construct

SEQ ID NO: 4321 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgatacgaactaa

SEQ ID NO: 4322 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRVDKHREGVAALSGGQQLALEPPDLARKERRSDTN

SEQ ID NO: 4323 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4324 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4325 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacgctcaccgctgaagaagaagagggagtaaaagaatcgcccaaagtactccgaatggctatcacaccttattatttgagtttgatagaccccgagaatcctaattgtccgattcgtaaacaagccattcctactcaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcagttggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacacttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcataaagagggcgtggctgcactttccggaggtcagcagttggctttagagcctcccgacttagctcgtaaagaacgcaggagcgataagaactaa

SEQ ID NO: 4326 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHKEGVAALSGGQQLALEPPDLARKERRSDKN

SEQ ID NO: 4327 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcttaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagtcgacaagcataaagagggcgtggctgcactttccggaggtcagcagttggctttagagcctcccgacttagctcgcaaagaacgcaggagcgataagaactaa

SEQ ID NO: 4328 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENLNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRVDKHKEGVAALSGGQQLALEPPDLARKERRSDKN

SEQ ID NO: 4329 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccagtgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagccgacaagcataaagagggcgtggctgcactttccggaggtcagcagttggctttagagcctcccgacttagctcgcaaagaacgcaggagcgataagaactaa

SEQ ID NO: 4330 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMASAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHKEGVAALSGGQQLALEPPDLARKERRSDKN

SEQ ID NO: 4331 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccggttcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4332 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPVRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRVDKHREGVAALSGGQQLALEPPDLARKERRSDKN

SEQ ID NO: 4333 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagtcggctttagagcctcccgacttagctcgcaaagaacgcaggagcgataagaactaa

SEQ ID NO: 4334 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQSALEPPDLARKERRSDKN

SEQ ID NO: 4335 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcacccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctacacggagccggaggactatcatgaggagtgcgattgtgaggactgccgagccgacaagcatcgtgagggcgtggctgcactttccggaggtcagcagttggctttagagcctcccgacttagctcgcaaagaacgcaggagcgataagaactaa

SEQ ID NO: 4336 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRADKHREGVAALSGGQQLALEPPDLARKERRSDKN

SEQ ID NO: 4337 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactcaacaggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagaaagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtaacgccgaactatgttgtatctcagtccccacgacatgtggttcttcgcaattatgaaggtgttatcacaacctatacggagccggaggactatcatgaggagtgcgattgtgaggactgccgagtcgacaagcataaagagggcgtggctgcactttccggaggtcagcagttggctttagagcctcccgacttagctcgcaaagaacgcaggagcgataagaactaa

SEQ ID NO: 4338 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTQQELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVTPNYVVSQSPRHVVLRNYEGVITTYTEPEDYHEECDCEDCRVDKHKEGVAALSGGQQLALEPPDLARKERRSDKN

SEQ ID NO: 4339 - DNA, 1251 bp, Artificial Sequence
  Description of Artificial Sequence: Synthetic Construct
atggcagaaagtcgtagaaagcattatttccctgacgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactaaacgggaactggtacgtgctcctgaagatatggtagacccacttagtgaagatgaagattcgcccgtacccggactgactcatcgttatccggatcgtgtattgttcctcatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggtgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcggtggaggcttgtgaaagaatggccaatgccggtattccgttgggtaaccaaacggttttattgcgtggaatcaatgattgtacgcacgtgatgaagagattggtacatttgctggtaaagattcgtgtgcgtccttactacatatatgcttgcgatctttcgcttggaatagggcatttccgcacgccggtatctaagggaatcgaaattatcaaaaatttgcgcggacacacctcgggctatgcagttcctacctttgtggtacatgctccggggggtggtggtaagatacctgtagcgccgaactatgttgtacctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4340 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIKNLRGHTSGYAVPTFVVHAPGGGGKIPVAPNYVVPQSPRHVVLRNYEGVITTYTEPEDYHEECDCEDCRVDKHREGVAALSGGQQLALEPPDLARKERRSDKN

SEQ ID NO: 4341 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagctattcctactaaacgggaactggtacgtgctcctgaagatatggtagacccacttagtgaagatgaagattcgcccgtacccggactgactcatcgttatccggatcgtgtattgttccttatcacggacaaatgtacgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacacgtgatgaagagattggtacatttgctggtaaagattcgtgtgcgtccttactatatatatgcttgcgatctttcgcttggaatagggcatttccgtacgccggtatctaagggaaccgaaattatcgaaaatttgcgcggacacacctcgggctatgcagttcctacctttgtggtacatgctccggggggtggtggtaagatacctgtggcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4342 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCTMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGTEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4343 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaactgtccgattcgtaaacaagccattcctactaaacgggaactggtacgtgctcctgaagatatggtagacccacttagtgaagatgaagattcgcccgtacccggactgactcatcgttatccggatcgtgtattgttcctcatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcggtggaggcttgtgaaagaatggccaatgccggtattccgttgggtaaccaaacggttttattgcgtggaatcaatgattgtacacatgtgatgaagaggttggtacatttgctggtaaagattcgtgtgcgtccttactatatatatgcttgcgatctttcgcttggaatagggcatttccgcacgccgatatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatggggagtgcgattgtgaggactgccgagccgacaagcatcgtgagggcgtggctgcactttccggaggtcagccgttggctttagagcctcccgacttagctcgcaaagaacgcaggagcgataagaactaa

SEQ ID NO: 4344 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPISKGIEIIENLRGHTSGYAVPTFVVHAPGGGGKIPVAPNYVVSQSPRHVVLRNYEGVITTYTEPEDYHGECDCEDCRADKHREGVAALSGGQPLALEPPDLARKERRSDKN

SEQ ID NO: 4345 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcggtggaggcttgtgaaagaatggccaatgccggtattccgttgggtaaccaaacggttttattgcgtggaatcaatgattgtacgcacgtgatgaagaggttggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccggactatgttgtatctcagtccccacgacatgtggttcttcgcaattatgaaggtgttatcacaacctatacggagccggaggactatcatggggagtgcgattgtgaggactgccgagccgacaagcatcgtgagggcgtggctgcactttccggaggtcagcagttggctttagagcctcccgacttagctcgcaaagaacgcaggagcgataagaactaa

SEQ ID NO: 4346 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPDYVVSQSPRHVVLRNYEGVITTYTEPEDYHGECDCEDCRADKHREGVAALSGGQQLALEPPDLARKERRSDKN

SEQ ID NO: 4347 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactaaacgggaactggtacgtgctcctgaagatatggtagacccacttagtgaagatgaagattcgcccgtacccggactgactcatcgttatccggatcgtgtattgttcctcatcacggacaaatgttcgatgtactgtcgtcattgtactcgccgtcgcttcgcgggacagagagatgcttcttccccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacctgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacaccacgggctatgcggttcctacctttgtggtacatgctccggggggtggtggtaagatacctgtggcgccgaactatgttgtatctcagtccccacgacatgtggttcttcgcaattatgaaggtgttatcacaacctatacggagccggaggactatcatgaggagtgcgattgtgaggactgccgagccgacaagcatcgtgagggcgtggctgcactttccggaggtcagcagttggctttagagcctcccgacttagctcgcaaagaacgcaggagcgataagagctaa

SEQ ID NO: 4348 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHLNEVTEEAVEACERMANAGIPLGNQTVLLRGINDCTHVMKRLVHLLVKIRVRPYYIYACDLSLGIGHFRTPVSKGIEIIENLRGHTTGYAVPTFVVHAPGGGGKIPVAPNYVVSQSPRHVVLRNYEGVITTYTEPEDYHEECDCEDCRADKHREGVAALSGGQQLALEPPDLARKERRSDKS

SEQ ID NO: 4349 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaactgtccgattcgtaaacaagccattcctactaaacgggaactggtacgtgctcctgaagatatggtagacccacttagtgaagatgaagattcgcccgtacccggactgactcatcgttatccggatcgtgtattgttcctcatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggtgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagaggttggtacatttgctggtaaagattcgtgtgcgtccttactatatatatgcttgcgatctttcgcttggaatagggcatttccgcacgccggtatccaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4350 - protein, 416 aa, Artificial Sequence; identical to SEQ ID NO: 3260
  Description of Artificial Sequence: Synthetic Construct

SEQ ID NO: 4351 - DNA, 1251 bp, Artificial Sequence
  Description of Artificial Sequence: Synthetic Construct
atggcagaaagtcgtagaaagcattacttccctgatgtcaccgataagcaatggtacgactggcattggcaggtcatcaatcgaattaagacgctcgaccagctggagaagtacgttacactcaccgctgaagaagaagagggagtaaaagagtcgcccaaagtactccgaatggctatcacgccttattatttgagtttgatagaccccgagaatcctaattgtccgattcgtaaacaagccattcctactaaacgggaactggtgcgtgctcctgaagatatggtagacccacttagtgaagatgaagattcgcccgtacccggactgactcatcgttatccggatcgcgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatctgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctaccttcgtggtacatgctccggggggtggtggtaagatacctgtagcgccgaactatgttgtatctcagtccccacgtcatgtggttcttcgcaattatgaaggtgttatcacaacctatacggagccggaggactatcatgaggagtgcggttgtgaggactgccgtgtcggcaagcataaagagggcgtggctgcactttccggaggtcagcagttggctctagagcctcccgacttagctcgcaaagaacgcaggttcgataagaactaa

SEQ ID NO: 4352 - protein, 416 aa, Artificial Sequence
  Description of Artificial Sequence: Synthetic Construct
MAESRRKHYFPDVTDKQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECGCEDCRVGKHKEGVAALSGGQQLALEPPDLARKERRFDKN

SEQ ID NO: 4353 - DNA, 1251 bp, Artificial Sequence
  Description of Artificial Sequence: Synthetic Construct
atggcagaaagtcgtagaaagcattacttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgatccgtaaacaagccattcctactaaacgggaactggtacgtgctcctgaagatatggtagacccgcttagtgaagatgaagattcgcccgtacccggactgactcatcgttatccggatcgtgtattgttccttatcacggacaaatgttcgatgtactgtcgtcattgtactcgccgtcgcttcgcgggacagaaagatgcttcttctccttctgagcgcatcgatcgatgcattgagtatatagccaatacaccgacagtccgcgatgttttgctatcgggaggcgatgccctccttgtcagcgacgaacgcttggagtacatactgaagcgtctgcgcgaagtacctcatgtggagattgttcgtataggaagccgtgcgccggtagtcctccctcagcgcataacgcctcaattggtggatatgctcaaaaaatatcatccggtgtggctgaacactcacttcaaccacccgaatgaagttaccgaagaagcagtggaggcttgtgagagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctaccttcgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgtgtcggcaagcatcgtgagggcgtggctacactttccggaggtcagcagttggctttagagcctcccgacttagctcgcaaagaacgcaggagcgataagaactaa

SEQ ID NO: 4354 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVGKHREGVATLSGGQQLALEPPDLARKERRSDKN

SEQ ID NO: 4355 - DNA, 1251 bp, Artificial Sequence
  Description of Artificial Sequence: Synthetic Construct
atggcagaaagtcgtagaaagcattacttccctgatgtcaccgataagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggtgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagcgattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgtggtatctcagtccccacgacatgtggttcttcgcaattatgaaggtgttatcacaacctatacggagccggaggactatcatgaggagtgcggttgtgaggactgccgagtcgacaagcatcgtgagggcgtggctgcactttccggaggtcagcagttggctctagagcctcccgacttagctcgcaaagaacgcaggagcgataagaactaa

SEQ ID NO: 4356 - protein, 416 aa, Artificial Sequence
  Description of Artificial Sequence: Synthetic Construct
MAESRRKHYFPDVTDKQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECGCEDCRVDKHREGVAALSGGQQLALEPPDLARKERRSDKN

SEQ ID NO: 4357 - DNA, 1251 bp, Artificial Sequence
  Description of Artificial Sequence: Synthetic Construct
atggcagaaagtcgtagaaagcattacttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaagatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacgcatgtgatgaagagattggtacatttgctggtaaagattcgtgtgcgtccttactacatatatgcttgcgatctttcgcttggaatagggcatttccgcacgccggtatctaagggaatcgaaattgtcgaaaatttgcgcggacacacctcgggctatgcagttcctacctttgtggtacatgctccggggggtggtggtaagatacctgcagcgccgaactatgttgtatctcagtccccacgacatgtggttcttcgcaattatgaaggtgttatcacaacctatacggagccggaggactatcatgaggagtgcgattgtgaggactgccgtgtcggcaagcataaagagggcgtggctgcactttccggaggtcagcagttggctttagagcctcccgacttagctcgcaaagaacgcaggagcgataagaactaa

SEQ ID NO: 4358 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKRYHPVWLNTHFNHPNEVTEEAVEACERMANAGIPLGNQTVLLRGINDCTHVMKRLVHLLVKIRVRPYYIYACDLSLGIGHFRTPVSKGIEIVENLRGHTSGYAVPTFVVHAPGGGGKIPAAPNYVVSQSPRHVVLRNYEGVITTYTEPEDYHEECDCEDCRVGKHKEGVAALSGGQQLALEPPDLARKERRSDKN

SEQ ID NO: 4359 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtgcgtgctcctgaagatatggtagacccacttagtgaagatgaagattcgcccgtacccggactaactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggtgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatcccgtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatctgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgtggtatctcagtccccacgacatgtggttcttcgcaattatgaaggtgttatcacaacctatacggagccggaggactatcatgaggagtgcgattgtgaggactgccgagtcgacaagcatcgtgagggcgtggctgaactttccggaggtcagcagttggctttagagcctcccgacttagctcgcaaagaacgcaagagcgataagaactaa

SEQ ID NO: 4360 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAELSGGQQLALEPPDLARKERKSDKN

SEQ ID NO: 4361 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtgcgtgctcctgaagatatggtagacccacttagtgaagatgaagattcgcccgtacccggactgactcatcgttatccggatcgcgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggcggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacgcatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctaccttcgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcggttgtgaggactgccgtgccggcaagcataaagagggcgtggctgcactttccggaggtcagcagttggctttagagcctcccgacttagctcgcaaagaacgcaagagcgataagaactaa

SEQ ID NO: 4362 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLADMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECGCEDCRAGKHKEGVAALSGGQQLALEPPDLARKERKSDKN

SEQ ID NO: 4363 - DNA, 1251 bp, Artificial Sequence
  Description of Artificial Sequence: Synthetic Construct
atggcagaaagtcgtagaaagcattatttccctgatgtcaccgatgagaaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactcaacgggaactggtgcgtgctcctgaagatatggtagacccacttagtgaagatgaagattcgcccgtacccggactgactcatcgttatccggatcgcgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatctgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgtgtcggcaagcataaagagggcgtggctgcactttccggaggtcagcagttggctttagagcctcccgacttagctcgcaaagaacgcaagttcgataagaactaa

SEQ ID NO: 4364 - protein, 416 aa, Artificial Sequence
  Description of Artificial Sequence: Synthetic Construct
MAESRRKHYFPDVTDEKWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVGKHKEGVAALSGGQQLALEPPDLARKERKFDKN

SEQ ID NO: 4365 - DNA, 1251 bp, Artificial Sequence
  Description of Artificial Sequence: Synthetic Construct
atggcagaaagtcgtagaaagcattacttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactaactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacgcatgtgatgaagcgattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctaccttcgtggtacatgctccggggggtggtggtaagatacctgtagcgccgaactatgtggtatctcagtccccacgacatgtggttcttcgcaattatgaaggtgttatcacaacctatacggagccggaggactatcatgaggagtgcgattgtgaggactgccgtgtcggcaagcatcgtgagggcgtggctgcactttccggaggtcagcagttggctctagagcctcccgacttagctcgcaaagaacgcaagttcgataagaactaa

SEQ ID NO: 4366 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVGKHREGVAALSGGQQLALEPPDLARKERKFDKN

SEQ ID NO: 4367 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtgcgtgctcctgaagatatggtagacccacttagtgaagatgaagattcgcccgtacccggactaactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggagtacatactgaagcgtctgcgcgaagtacctcatgtggagattgttcgtataggaagccgtgcgccggtagtcctccctcagcgcataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatctgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctaccttcgtggtacatgctccggggggtggtggtaagatacctgtagcgccgaactatgttgtatctcagtccccacgtcatgtggttcttcgcaattatgaaggtgttatcacaacctatacggagccggaggactatcatgaggagtgcgattgtgaggactgccgtgccggcaagcatcgtgagggcgtggctgcactttccggaggtcagcagttggctctagagcctcccgacttagctcgcaaagaacgcaagttcgataagaactaa

SEQ ID NO: 4368 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRAGKHREGVAALSGGQQLALEPPDLARKERKFDKN

SEQ ID NO: 4369 - DNA, 1251 bp, Artificial Sequence
  Description of Artificial Sequence: Synthetic Construct
atggcagaaagtcgtagaaagcattacttccctgatgtcaccgatgagcaatggtacgactggcattggcaggtcatcaatcgaattaagacgctcgaccagctggagaagtacgttacactcaccgctgaagaagaagagggagtaaaagagtcgcccaaagtactccgaatggctatcacgccttattatttgagtttgatagaccccgagaatcctaattgtccgattcgtaaacaagccattcctactaaacgggaactggtgcgtgctcctgaagatatggtagacccacttagtgaagatgaagattcgcccgtacccggactgactcatcgttatccggatcgcgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctaaacactcacttcaaccacccgaatgaagttaccgaagaagcagtggaggcttgtgaaagaatggccaatgccggtattccgttgggtaaccaaacggttttattgcgtggaatcaatgattgtacgcatgtgatgaagcgattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgtggtatctcagtccccacgacatgtggttcttcgcaattatgaaggtgttatcacaacctatacggagccggaggactatcatgaggagtgcgattgtgaggactgccgtgtcgacaagcataaagagggcgtggctgaactttccggaggtcagcagttggctttagagcctcccgacttagctcgcaaagaacgcaggttcgataagaactaa

SEQ ID NO: 4370 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHKEGVAELSGGQQLALEPPDLARKERRFDKN

SEQ ID NO: 4371 - DNA, 1251 bp, Artificial Sequence
  Description of Artificial Sequence: Synthetic Construct
atggcagaaagtcgtagaaagcattatttccctgatgtcaccgataagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtgcgtgctcctgaagatatggtagacccacttagtgaagatgaagattcgcccgtacccggactaactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctaccttcgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4372 - protein, 416 aa, Artificial Sequence
  Description of Artificial Sequence: Synthetic Construct
MAESRRKHYFPDVTDKQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4373 - DNA, 1251 bp, Artificial Sequence
  Description of Artificial Sequence: Synthetic Construct
atggcagaaagtcgtagaaagcattacttccctgatgtcaccgatgagcaatggtacgactggcattggcaggtcatcaatcgaattaagacgctcgaccagctggagaagtacgttacactcaccgctgaagaagaagagggagtaaaagagtcgcccaaagtactccgaatggctatcacgccttattatttgagtttgatagaccccgagaatcctaattgtccgattcgtaaacaagccattcctactcaacgggaactggtacgtgctcctgaagatatggtagacccacttagtgaagatgaagattcgcccgtacccggactaactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacggacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagcgattggtacatctgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcggttgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4374 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQRDASSPSERIDRCIEYIANTPTVRDVLLSGGDALLVSDGRLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECGCEDCRVDKHREGVAALSGGQQLALEPPDLARKERRSDKN

SEQ ID NO: 4375 - DNA, 1251 bp, Artificial Sequence
  Description of Artificial Sequence: Synthetic Construct
atggcagaaagtcgtagaaagcattacttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactcaacgggaactggtacgtgctcctgaagatatggtagacccacttagtgaagatgaagattcgcccgtacccggactaactcatcgttatccggatcgcgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggagtacatactgaagcgtctgcgcgaagtacctcatgtggagattgttcgtataggaagccgtgcgccggtagtcctccctcagcgcataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctaccttcgtggtacatgctccggggggtggtggtaagatacctgtagcgccgaactatgtggtatctcagtccccacgacatgtggttcttcgcaattatgaaggtgttatcacaacctatacggagccggaggactatcatgaggagtgcggttgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4376 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECGCEDCRVDKHREGVAALSGGQQLALEPPDLARKERRSDKN

SEQ ID NO: 4377 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactcaacgggaactggtgcgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatctgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgtggtatctcagtccccacgacatgtggttcttcgcaattatgaaggtgttatcacaacctatacggagccggaggactatcatgaggagtgcggttgtgaggactgccgtgccggcaagcatcgtgagggcgtggctgcactttccggaggtcagcagttggctctagagcctcccgacttagctcgcaaagaacgcaggagcgataagaactaa

SEQ ID NO: 4378 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECGCEDCRAGKHREGVAALSGGQQLALEPPDLARKERRSDKN

SEQ ID NO: 4379 - DNA, 1251 bp, Artificial Sequence
  Description of Artificial Sequence: Synthetic Construct
atggcagaaagtcgtagaaagcattacttccctgatgtcaccgataagcaatggtacgactggcattggcaggtcatcaatcgaattaagacgctcgaccagctggagaagtacgttacactcaccgctgaagaagaagagggagtaaaagagtcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactaactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggagtacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagcgattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcggttgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4380 - protein, 416 aa, Artificial Sequence; identical to SEQ ID NO: 4356
  Description of Artificial Sequence: Synthetic Construct

SEQ ID NO: 4381 - DNA, 1251 bp, Artificial Sequence
  Description of Artificial Sequence: Synthetic Construct
atggcagaaagtcgtagaaagcattacttccctgatgtcaccgataagcaatggtacgactggcattggcaggtcatcaatcgaattaagacgctcgaccagctggagaagtacgttacactcaccgctgaagaagaagagggagtaaaagagtcgcccaaagtactccgaatggctatcacgccttattatttgagtttgatagaccccgagaatcctaattgtccgattcgtaaacaagccattcctactaaacgggaactggtgcgtgctcctgaagatatggtagacccacttagtgaagatgaagattcgcccgtacccggactgactcatcgttatccggatcgcgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgaactttccggaggtcagcagttggctttagagcctcccgacttagctcgcaaagaacgcaggagcgataagaactaa

SEQ ID NO: 4382 - protein, 416 aa, Artificial Sequence
  Description of Artificial Sequence: Synthetic Construct
MAESRRKHYFPDVTDKQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAELSGGQQLALEPPDLARKERRSDKN

SEQ ID NO: 4383 - DNA, 1251 bp, Artificial Sequence
  Description of Artificial Sequence: Synthetic Construct
atggcagaaagtcgtagaaagcattacttccctgatgtcaccgataagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactcaacgggaactggtacgtgctcctgaagatatggtagacccacttagtgaagatgaagattcgcccgtacccggactaactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatctgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgtcatgtggttcttcgcaattatgaaggtgttatcacaacctatacggagccggaggactatcatgaggagtgcgattgtgaggactgccatgtcggcaagcataaagagggcgtggctgcactttccggaggtcagcagttggctttagagcctcccgacttagctcgcaaagaacgcaggagcgataagaactaa

SEQ ID NO: 4384 - protein, 416 aa, Artificial Sequence
  Description of Artificial Sequence: Synthetic Construct
MAESRRKHYFPDVTDKQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCHVGKHKEGVAALSGGQQLALEPPDLARKERRSDKN

SEQ ID NO: 4385 - DNA, 1251 bp, Artificial Sequence
  Description of Artificial Sequence: Synthetic Construct
atggcagaaagtcgtagaaagcattatttccctgatgtcaccgataagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgtggtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4386 - protein, 416 aa, Artificial Sequence; identical to SEQ ID NO: 4372
  Description of Artificial Sequence: Synthetic Construct

SEQ ID NO: 4387 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtgcgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgtcttgctatcgggaggtgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagcgattggtacatctgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaaggtacctgtagcgccgaactatgtggtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4388 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKVPVAPNYVVSQSPRHVVLRNYEGVITTYTEPEDYHEECDCEDCRVDKHREGVAALSGGQQLALEPPDLARKERRSDKN

SEQ ID NO: 4389 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgcgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctaccttcgtggtacatgctccggggggtggtggtaagatacctgtagcgccgaactatgtggtatctcagtccccacgtcatgtggttcttcgcaattatgaaggtgttatcacaacctatacggagccggaggactatcatgaggagtgcggttgtgaggactgccgtgtcggcaagcataaagagggcgtggctacactttccggaggtcagcagttggctttagagcctcccgacttagctcgcaaagaacgcaagagcgataagaactaa

SEQ ID NO: 4390 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECGCEDCRVGKHKEGVATLSGGQQLALEPPDLARKERKSDKN

SEQ ID NO: 4391 - DNA, 1251 bp, Artificial Sequence
  Description of Artificial Sequence: Synthetic Construct
atggcagaaagtcgtagaaagcattacttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactaactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatctgctggtaaagattcgtgtgcgtccttactacatatatgcttgcgatctttcgcttggaatagggcatttccgcacgccagtatctaagggaatcgaaattatcgaaaatttgcgcggacacacctcgggctatgcagttcctaccttcgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4392 - protein, 416 aa, Artificial Sequence; identical to SEQ ID NO: 3260
  Description of Artificial Sequence: Synthetic Construct

SEQ ID NO: 4393 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagagtcgcccaaagtactccgaatggctatcacgccttattatttgagtttgatagaccccgagaatcctaattgtccgattcgtaaacaagccattcctactcaacgggaactggtgcgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcggttgtgaggactgccgagtcgacaagcatcgtgagggcgtggctacactttccggaggtcagcagttggctttagagcctcccgacttagctcgcaaagaacgcaggagcgataagaactaa

SEQ ID NO: 4394 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECGCEDCRVDKHREGVATLSGGQQLALEPPDLARKERRSDKN

SEQ ID NO: 4395 - DNA, 1251 bp, Artificial Sequence
  Description of Artificial Sequence: Synthetic Construct
atggcagaaagtcgtagaaagcattacttccctgatgtcaccgatgagcaatggtacgactggcattggcaggtcatcaatcgaattaagacgctcgaccagctggagaagtacgttacactcaccgctgaagaagaagagggagtaaaagagtcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactaactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagcgattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctaccttcgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcggcaagcataaagagggcgtggctgcactttccggaggtcagcagttggctttagagcctcccgacttagctcgcaaagaacgcaggagcgataagaactaa

SEQ ID NO: 4396 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVGKHKEGVAALSGGQQLALEPPDLARKERRSDKN

SEQ ID NO: 4397 - DNA, 1251 bp, Artificial Sequence
  Description of Artificial Sequence: Synthetic Construct
atggcagaaagtcgtagaaagcattacttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactcaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgccagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagcgattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4398 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQRDASSPSERIDRCIEYIANTPTVRDVLLSGGDALLASDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4399 - DNA, 1251 bp, Artificial Sequence
  Description of Artificial Sequence: Synthetic Construct
atggcagaaagtcgtagaaagcattatttccctgatgtcaccgataagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactcaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagaaagatgcttcttctccttctgagcgcatcgatcgatgcattgagtatatagccaatacaccgacagtccgcgatgttttgctatcgggaggcgatgccctccttgtcagcgacgaacgcttggaatacattctgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatctgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcataaagagggcgtggctacactttccggaggtcagcagttggctttagagcctcccgacttagctcgcaaagaacgcaggagcgataagaactaa

SEQ ID NO: 4400 - protein, 416 aa, Artificial Sequence
  Description of Artificial Sequence: Synthetic Construct
MAESRRKHYFPDVTDKQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHKEGVATLSGGQQLALEPPDLARKERRSDKN

SEQ ID NO: 4401 - DNA, 1251 bp, Artificial Sequence
  Description of Artificial Sequence: Synthetic Construct
atggcagaaagtcgtagaaagcattatttccctgatgtcaccgataagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactaactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgcataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagcgattggtacatctgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctaccttcgtggtacatgctccggggggtggtggtaagatacctgtagcgccgaactatgtggtatctcagtccccacgacatgtggttcttcgcaattatgaaggtgttatcacaacctatacggagccggaggactatcatgaggagtgcgattgtgaggactgccgagtcgacaagcatcgtgagggcgtggctgaactttccggaggtcagcagttggctttagagcctcccgacttagctcgcaaagaacgcaggttcgataagaactaa

SEQ ID NO: 4402 - protein, 416 aa, Artificial Sequence
  Description of Artificial Sequence: Synthetic Construct
MAESRRKHYFPDVTDKQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAELSGGQQLALEPPDLARKERRFDKN

SEQ ID NO: 4403 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagacccccagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagcgattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgtggtatctcagtccccacgacatgtggttcttcgcaattatgaaggtgttatcacaacctatacggagccggaggactatcatgaggagtgcgattgtgaggactgccgagtcgacaagcatcgtgagggcgtggctacactttccggaggtcagcagttggctttagagcctcccgacttagctcgcaaagaacgcaggttcgataagaactaa

SEQ ID NO: 4404 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPQNPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVATLSGGQQLALEPPDLARKERRFDKN

SEQ ID NO: 4405 - DNA, 1251 bp, Artificial Sequence
  Description of Artificial Sequence: Synthetic Construct
atggcagaaagtcgtagaaagcattatttccctgatgtcaccgataagcaatggtacgactggcattggcaggtcatcaatcgaattaagacgctcgaccagctggagaagtacgttacactcaccgctgaagaagaagagggagtaaaagagtcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactaactcatcgttatccggatcgcgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggtgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcggttgtgaggactgccgagtcggcaagcataaagagggcgtggctgcactttccggaggtcagcagttggctttagagcctcccgacttagctcgcaaagaacgcaggagcgataagaactaa

SEQ ID NO: 4406 - protein, 416 aa, Artificial Sequence
  Description of Artificial Sequence: Synthetic Construct
MAESRRKHYFPDVTDKQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECGCEDCRVGKHKEGVAALSGGQQLALEPPDLARKERRSDKN

SEQ ID NO: 4407 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtgcgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagaaagatgcttcttctccttctgagcgcatcgatcgatgcattgagtatatagccaatacaccgacagtccgcgatgttttgctatcgggaggtgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatctgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgtggtatctcagtccccacgacatgtggttcttcgcaattatgaaggtgttatcacaacctatacggagccggaggactatcatgaggagtgcgattgtgaggactgccgtgccgacaagcataaagagggcgtggctacactttccggaggtcagcagttggctttagagcctcccgacttagctcgcaaagaacgcaggagcgataagaactaa

SEQ ID NO: 4408 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRADKHKEGVATLSGGQQLALEPPDLARKERRSDKN

SEQ ID NO: 4409 - DNA, 1251 bp, Artificial Sequence
  Description of Artificial Sequence: Synthetic Construct
atggcagaaagtcgtagaaagcattatttccctgatgtcaccgataagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgcgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagccccccgacttagctcgcaaagaacgcaggagcgataagaactaa

SEQ ID NO: 4410 - protein, 416 aa, Artificial Sequence; identical to SEQ ID NO: 4372
  Description of Artificial Sequence: Synthetic Construct

SEQ ID NO: 4411 - DNA, 1251 bp, Artificial Sequence
  Description of Artificial Sequence: Synthetic Construct
atggcagaaagtcgtagaaagcattacttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactcaacgggaactggtgcgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcggttgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4412 - protein, 416 aa, Artificial Sequence; identical to SEQ ID NO: 4376
  Description of Artificial Sequence: Synthetic Construct

SEQ ID NO: 4413 - DNA, 1251 bp, Artificial Sequence
  Description of Artificial Sequence: Synthetic Construct
atggcagaaagtcgtagaaagcattacttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtgcgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagaaagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgcataacgcctcaattggtggatatgctcaaaaaatatcatccggtgtggctgaacactcacttcaaccacccgaatgaagttaccgaagaagcagtggagacttgtgaaagaatggccaatgccggtattccgttgggtaaccaaacggttttattgcgtggaatcaatgattgtacgcatgtgatgaagcgattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgtggtatctcagtccccacgacatgtggttcttcgcaattatgaaggtgttatcacaacctatacggagccggaggactatcatgaggagtgcgattgtgaggactgccgtgtcgacaagcatcgtgagggcgtggctgcactttccggaggtcagcagttggctctagagcctcccgacttagctcgcaaagaacgcaggagcgataagaactaa

SEQ ID NO: 4414 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVETCERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4415 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggagtacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatctgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4416 - protein, 416 aa, Artificial Sequence; identical to SEQ ID NO: 3260
  Description of Artificial Sequence: Synthetic Construct

SEQ ID NO: 4417 - DNA, 1251 bp, Artificial Sequence
  Description of Artificial Sequence: Synthetic Construct
atggcagaaagtcgtagaaagcattacttccctgatgtcaccgataagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtgcgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcggtgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgtgtcggcaagcatcgtgagggcgtggctgcactttccggaggtcagcagttggctttagagcctcccgacttagctcgcaaagaacgcaagagcgataagaactaa

SEQ ID NO: 4418 - protein, 416 aa, Artificial Sequence
  Description of Artificial Sequence: Synthetic Construct
MAESRRKHYFPDVTDKQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVGKHREGVAALSGGQQLALEPPDLARKERKSDKN

SEQ ID NO: 4419 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagagtcgcccaaagtactccgaatggctatcacgccttattatttgagtttgatagaccccgagaatcctaattgtccgattcgtaaacaagccattcctactaaacgggaactggtgcgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggtgatgccctccttgtcagcgacgaacgcttggaatacatactgaagcgtctgcgcgaagtacctcatgtggagattgttcgtataggaagccgtgcgccggtagtcctccctcagcgcataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagcgattggtacatctgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgtgtcggcaagcatcgtgagggcgtggctgcactttccggaggtcagcagttggctttagagcctcccgacttagctcgcaaagaacgcaggttcgataagaactaa

SEQ ID NO: 4420 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVGKHREGVAALSGGQQLALEPPDLARKERRFDKN

SEQ ID NO: 4421 - DNA, 1251 bp, Artificial Sequence
  Description of Artificial Sequence: Synthetic Construct
atggcagaaagtcgtagaaagcattacttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacttactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacgcatgtgatgaagagattggtacatctgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaagagcgataagaactaa

SEQ ID NO: 4422 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYLLKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERKSDKN

SEQ ID NO: 4423 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtgcgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatctgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgtggtatctcagtccccacgacatgtggttcttcgcaattatgaaggtgttatcacaacctatacggagccggaggactatcatgaggagtgcggttgtgaggactgccgagtcgacaagcatcgtgagggcgtggctgcactttccggaggtcagcagttggctttagagcctcccgacttagctcgcaaagaacgcaggttcgataagaactaa

SEQ ID NO: 4424 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECGCEDCRVDKHREGVAALSGGQQLALEPPDLARKERRFDKN

SEQ ID NO: 4425 - DNA, 1251 bp, Artificial Sequence
  Description of Artificial Sequence: Synthetic Construct
atggcagaaagtcgtagaaagcattatttccctgatgtcaccgataagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactcaacgggaactggtgcgtgctcctgaagatatggtagacccacttagtgaagatgaagattcgcccgtacccggactaactcatcgttatccggatcgtgtattgttccttatcacggacaaatgttcgatgtactgtcgtcattgtactcgccgtcgcttcgcgggacagaaagatgcttcttctccttctgagcgcatcgatcgatgcattgagtatatagccaatacaccgacagtccgcgatgttttgctatcgggaggcgatgccctccttgtcagcgacgaacgcttggagtacatactgaagcgtctgcgcgaagtacctcatgtggagattgttcgtataggaagccgtgcgccggtagtcctccctcagcgtataacgcctcaattggtggatatgctcaaaaaatatcatcccgtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatctgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgtggtatctcagtccccacgtcatgtggttcttcgcaattatgaaggtgttatcacaacctatacggagccggaggactatcatgaggagtgcgattgtgaggactgccgagccgacaagcatcgtgagggcgtggctgcactttccggaggtcagcagttggctttagagcctcccgacttagctcgcaaagaacgcaagagcgataagaactaa

SEQ ID NO: 4426 - protein, 416 aa, Artificial Sequence
  Description of Artificial Sequence: Synthetic Construct
MAESRRKHYFPDVTDKQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRADKHREGVAALSGGQQLALEPPDLARKERKSDKN

SEQ ID NO: 4427 - DNA, 1251 bp, Artificial Sequence
  Description of Artificial Sequence: Synthetic Construct
atggcagaaagtcgtagaaagcattacttccctgatgtcaccgataagcaatggtacgactggcattggcaggtcatcaatcgaattaagacgctcgaccagctggagaagtacgttacactcaccgctgaagaagaagagggagtaaaagaatcgcccaaagtactccgaatggctatcacgccctattatttgagtttgatagaccccgagaatcctaattgtccgattcgcaaacaagccattcctactcaacgggaactagtacgtgctcctgaagatatggtagacccacttagtgaagatgaagattcgcccgtacccggactaactcatcgttatccggatcgtgtattgttccttatcacggacaaatgttcgatgtactgtcgtcattgtactcgccgtcgcttcgcgggacagaaagatgcttcttctccttctgagcgcatcgatcgatgcattgagtatatagccaatacaccgacagtccgcgatgttttgctatcgggaggcgatgccctccttgtcagcgacgaacgcttggagtacatactgaagcgtctgcgcgaagtacctcatgtggagattgttcgtataggaagccgtgcgccggtagtcctccctcagcgcataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacgcatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgtggtatctcggtccccacgacatgtggttcttcgcaattatgaaggtgttatcacaacctatacggagccggaggactatcatgaggagtgcggttgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4428 - protein, 416 aa, Artificial Sequence
  Description of Artificial Sequence: Synthetic Construct
MAESRRKHYFPDVTDKQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSRSPRHVVLRNYEGVITTYTEPEDYHEECGCEDCRVDKHREGVAALSGGQQLALEPPDLARKERRSDKN

SEQ ID NO: 4429 - DNA, 1251 bp, Artificial Sequence
  Description of Artificial Sequence: Synthetic Construct
atggcagaaagtcgtagaaagcattacttccctgatgtcaccgataagcaatggtacgactggcattggcaggtcatcaatcgaattaagacgctcgaccagctggagaagtacgttacactcaccgctgaagaagaagagggagtaaaagagtcgcccaaagtactccgaatggctatcacgccttattatttgagtttgatagaccccgagaatcctaattgtccgattcgtaaacaagccattcctactcaacgggaactggtgcgtgctcctgaagatatggtagacccacttagtgaagatgaagattcgcccgtacccggactaactcatcgttatccggatcgcgtattgttccttatcacggacaaatgttcgatgtactgtcgtcattgtactcgccgtcgcttcgcgggacagaaagatgcttcttctccttctgagcgcatcgatcgatgcattgagtatatagccaatacaccgacagtccgcgatgttttgctatcgggaggtgatgccctccttgtcagcgacgaacgcttggagtacatactgaagcgtctgcgcgaagtacctcatgtggagattgttcgtataggaagccgtgcgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgtggtatctcagtccccacgtcatgtggttcttcgcaattatgaaggtgttatcacaacctatacggagccggaggactatcatgaggagtgcggttgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4430 - protein, 416 aa, Artificial Sequence
  Description of Artificial Sequence: Synthetic Construct
MAESRRKHYFPDVTDKQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECGCEDCRVDKHREGVAALSGGQQLALEPPDLARKERRSDKN

SEQ ID NO: 4431 - DNA, 1251 bp, Artificial Sequence
  Description of Artificial Sequence: Synthetic Construct
atggcagaaagtcgtagaaagcattacttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgcgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggtgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacgcatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgtggtatctcagtccccacgacatgtggttcttcgcaattatgaaggtgttatcacaacctatacggagccggaggactatcatgaggagtgcggttgtgaggactgccgtgccggcaagcatcgtgagggcgtggctgcactttccggaggtcagcagttggctttagagcctcccgacttagctcgcaaagaacgcaagttcgataagaactaa

SEQ ID NO: 4432 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECGCEDCRAGKHREGVAALSGGQQLALEPPDLARKERKFDKN

SEQ ID NO: 4433 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactcaacgggaactggtgcgtgctcctgaagatatggtagacccacttagtgaagatgaagattcgcccgtacccggactgactcatcgttatccggatcgcgtattgttccttatcacggacaaatgttcgatgtactgtcgtcattgtactcgccgtcgcttcgcgggacagaaagatgcttcttctccttctgagcgcatcgatcgatgcattgagtatatagccaatacaccgacagtccgcgatgttttgctatcgggaggtgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacgcatgtgatgaagagattggtacatctgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcggttgtgaggactgccgagtcgacaagcatcgtgagggcgtggctgcactttccggaggtcagcagttggctttagagcctcccgacttagctcgcaaagaacgcaagttcgataagaactaa

SEQ ID NO: 4434 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECGCEDCRVDKHREGVAALSGGQQLALEPPDLARKERKFDKN

SEQ ID NO: 4435 - DNA, 1251 bp, Artificial Sequence
  Description of Artificial Sequence: Synthetic Construct
atggcagaaagtcgtagaaagcattacttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactcaacgggaactggtgcgtgctcctgaagatatggtagacccacttagtgaagatgaagattcgcccgtacccggactaactcatcgttatccggatcgtgtattgttccttatcacggacaaatgttcgatgtactgtcgtcattgtactcgccgtcgcttcgcgggacagaaagatgcttcttctccttctgagcgcatcgatcgatgcattgagtatatagccaatacaccgacagtccgcgatgttttgctatcgggaggtgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctaccttcgtggtacatgctccggggggtggtggtaagatacctgtagcgccgaactatgtggtatctcagtccccacgacatgtggttcttcgcaattatgaaggtgttatcacaacctatacggagccggaggactatcatgaggagtgcgattgtgaggactgccgagtcgacaagcatcgtgagggcgtggctacactttccggaggtcagcagttggctttagagcctcccgacttagctcgcaaagaacgcaggttcgataagaactaa

SEQ ID NO: 4436 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVATLSGGQQLALEPPDLARKERRFDKN

SEQ ID NO: 4437 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagagtcgcccaaagtactccgaatggctatcacgccttattatttgagtttgattgaccccgagaatcctaattgtccgattcgtaaacaagccattcctactcaacgggaactggtgcgtgctcctgaagatatggtagacccacttagtgaagatgaagattcgcccgtacccggactgactcatcgttatccggatcgcgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacgcatgtgatgaagcgattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctaccttcgtggtacatgctccggggggtggtggtaagatacctgtagcgccgaactatgtggtatctcagtccccacgacatgtggttcttcgcaattatgaaggtgttatcacaacctatacggagccggaggactatcatgaggagtgcggttgtgaggactgccgtgtcggcaagcatcgtgagggcgtggctgcactttccggaggtcagcagttggctttagagcctcccgacttagctcgcaaagaacgcaagttcgataagaactaa

SEQ ID NO: 4438 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECGCEDCRVGKHREGVAALSGGQQLALEPPDLARKERKFDKN

SEQ ID NO: 4439 - DNA, 1251 bp, Artificial Sequence
  Description of Artificial Sequence: Synthetic Construct
atggcagaaagtcgtagaaagcattacttccctgatgtcaccgataagcaatggtacgactggcattggcaggtcatcaatcgaattaagacgctcgaccagctggagaagtacgttacactcaccgctgaagaagaagagggagtaaaagagtcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagaaagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctaccttcgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgtgtcggcaagcatcgtgagggcgtggctgcactttccggaggtcagcagttggctctagagcctcccgacttagctcgcaaagaacgcaagttcgataagaactaa

SEQ ID NO: 4440 - protein, 416 aa, Artificial Sequence
  Description of Artificial Sequence: Synthetic Construct
MAESRRKHYFPDVTDKQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVGKHREGVAALSGGQQLALEPPDLARKERKFDKN

SEQ ID NO: 4441 - DNA, 1251 bp, Artificial Sequence
  Description of Artificial Sequence: Synthetic Construct
atggcagaaagtcgtagaaagcattatttccctgatgtcaccgataagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtgcgtgctcctgaagatatggtagacccacttagtgaagatgaagattcgcccgtacccggactgactcatcgttatccggatcgcgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggagtacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagccggcaagcataaagagggcgtggctgcactttccggaggtcagcagttggctttagagcctcccgacttagctcgcaaagaacgcaggttcgataagaactaa

SEQ ID NO: 4442 - protein, 416 aa, Artificial Sequence
  Description of Artificial Sequence: Synthetic Construct
MAESRRKHYFPDVTDKQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRAGKHKEGVAALSGGQQLALEPPDLARKERRFDKN

SEQ ID NO: 4443 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgcgtattgttccttatcacggacaaatgttcgatgtactgtcgtcattgtactcgccgtcgcttcgcgggacagaaagatgcttcttctccttctgagcgcatcgatcgatgcattgagtatatagccaatacaccgacagtccgcgatgttttgctatcgggaggtgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacgcatgtgatgaagcgattggtacatctgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctaccttcgtggtacatgctccggggggtggtggtaagatacctgtagcgccgaactatgttgtatcccagtccccacgacatgtggttcttcgcaattatgaaggtgttatcacaacctatacggagccggaggactatcatgaggagtgcgattgtgaggactgccgtgccggcaagcataaagagggcgtggctgcactttccggaggtcagcagttggctttagagcctcccgacttagctcgcaaagaacgcaggagcgataagaactaa

SEQ ID NO: 4444 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRAGKHKEGVAALSGGQQLALEPPDLARKERRSDKN

SEQ ID NO: 4445 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatctgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagaaagatgcttcttctccttctgagcgcatcgatcgatgcattgagtatatagccaatacaccgacagtccgcgatgttttgctatcgggaggcgatgccctccttgtcagcgacgaacgcttggagtacatactgaagcgtctgcgcgaagtacctcatgtggagattgttcgtataggaagccgtgcgccggtagtcctccctcagcgcataacgcctcaattggtggatatgctcaaaaaatatcatcccgtgtggctgaacactcacttcaaccacccgaatgaagttaccgaagaagcagtggaggcttgtgaaagaatggccaatgccggtattccgttgggtaaccaaacggttttattgcgtggaatcaatgattgtacgcatgtgatgaagagattggtacatctgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctaccttcgtggtacatgctccggggggtggtggtaagatacctgtagcgccgaactatgtggtatctcagtccccacgtcatgtggttcttcgcaattatgaaggtgttatcacaacctatacggagccggaggactatcatgaggagtgcggttgtgaggactgccgagtcggcaagcatcgtgagggcgtggctgcactttccggaggtcagcagttggctttagagcctcccgacttagctcgcaaagaacgcaagagcgataagaactaa

SEQ ID NO: 4446 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECGCEDCRVGKHREGVAALSGGQQLALEPPDLARKERKSDKN

SEQ ID NO: 4447 - DNA, 1251 bp, Artificial Sequence
  Description of Artificial Sequence: Synthetic Construct
atggcagaaagtcgtagaaagcattacttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtgcgtgctcctgaagatatggtagacccacttagtgaagatgaagattcgcccgtacccggactgactcatcgttatccggatcgcgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggtgatgccctccttgtcagcgacgaacgcttggaatacatactgaagcgtctgcgcgaagtacctcatgtggagattgttcgtataggaagccgtgcgccggtagtcctccctcagcgcataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacgcatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcataaagagggcgtggctgcactttccggaggtcagcagttggctttagagcctcccgacttagctcgcaaagaacgcaagttcgataagaactaa

SEQ ID NO: 4448 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHKEGVAALSGGQQLALEPPDLARKERKFDKN

SEQ ID NO: 4449 - DNA, 1251 bp, Artificial Sequence
  Description of Artificial Sequence: Synthetic Construct
atggcagaaagtcgtagaaagcattacttccctgatgtcaccgataagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactcaacgggaactggtacgtgctcctgaagatatggtagacccacttagtgaagatgaagattcgcccgtacccggactaactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatctgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcggttgtgaggactgccgagccggcaagcatcgtgagggcgtggctacactttccggaggtcagcagttggctctagagcctcccgacttagctcgcaaagaacgcaggttcgataagaactaa

SEQ ID NO: 4450 - protein, 416 aa, Artificial Sequence
  Description of Artificial Sequence: Synthetic Construct
MAESRRKHYFPDVTDKQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECGCEDCRAGKHREGVATLSGGQQLALEPPDLARKERRFDKN

SEQ ID NO: 4451 - DNA, 1251 bp, Artificial Sequence
  Description of Artificial Sequence: Synthetic Construct
atggcagaaagtcgtagaaagcattacttccctgatgtcaccgataagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactcaacgggaactggtgcgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggtgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatctgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcggttgtgaggactgccgagtcgacaagcatcgtgagggcgtggctgcactttccggaggtcagcagttggctttagagcctcccgacttagctcgcaaagaacgcaagagcgataagaactaa

SEQ ID NO: 4452 - protein, 416 aa, Artificial Sequence
  Description of Artificial Sequence: Synthetic Construct
MAESRRKHYFPDVTDKQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECGCEDCRVDKHREGVAALSGGQQLALEPPDLARKERKSDKN

SEQ ID NO: 4453 - DNA, 1251 bp, Artificial Sequence
  Description of Artificial Sequence: Synthetic Construct
atggcagaaagtcgtagaaagcattatttccctgatgtcaccgataagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagaaagatgcttcttctccttctgagcgcatcgatcgatgcattgagtatatagccaatacaccgacagtccgcgatgttttgctatcgggaggtgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacgcatgtgatgaagagattggtacatctgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgtgtcgacaagcatcgtgagggcgtggctgcactttccggaggtcagcagttggctttagagcctcccgacttagctcgcaaagaacgcaggagcgataagaactaa

SEQ ID NO: 4454 - protein, 416 aa, Artificial Sequence
  Description of Artificial Sequence: Synthetic Construct
MAESRRKHYFPDVTDKQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4455 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagagtcgcccaaagtactccgaatggctatcacgccttattatttgagtttgatagaccccgagaatcctaattgtccgattcgtaaacaagccattcctactcaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggtgatgccctccttgtcggcgacgaacgcttggaatacatactgaagcgtctgcgcgaagtacctcatgtggagattgttcgtataggaagccgtgcgccggtagtcctccctcagcgcataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcggttgtgaggactgccgagtcggcaagcataaagagggcgtggctgcactttccggaggtcagcagttggctttagagcctcccgacttagctcgcaaagaacgcaggagcgataagaactaa

SEQ ID NO: 4456 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQRDASSPSERIDRCIEYIANTPTVRDVLLSGGDALLVGDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECGCEDCRVGKHKEGVAALSGGQQLALEPPDLARKERRSDKN

SEQ ID NO: 4457 - DNA, 1251 bp, Artificial Sequence
  Description of Artificial Sequence: Synthetic Construct
atggcagaaagtcgtagaaagcattacttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactcaacgggaactggtgcgtgctcctgaagatatggtagacccacttagtgaagatgaagattcgcccgtacccggactaactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggagtacatactgaagcgtctgcgcgaagtacctcatgtggagattgttcgtataggaagccgtgcgccggtagtcctccctcagcgcataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacgcatgtgatgaagcgattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgtcatgtggttcttcgcaattatgaaggtgttatcacaacctatacggagccggaggactatcatgaggagtgcgattgtgaggactgccgagccggcaagcatcgtgagggcgtggctgcactttccggaggtcagcagttggctttagagcctcccgacttagctcgcaaagaacgcaggttcgataagaactaa

SEQ ID NO: 4458 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRAGKHREGVAALSGGQQLALEPPDLARKERRFDKN

SEQ ID NO: 4459 - DNA, 1251 bp, Artificial Sequence
  Description of Artificial Sequence: Synthetic Construct
atggcagaaagtcgtagaaagcattacttccctgatgtcaccgatgagcaatggtacgactggcattggcaggtcatcaatcgaattaagacgctcgaccagctggagaagtacgttacactcaccgctgaagaagaagagggagtaaaagagtcgcccaaagtactccgaatggctatcacgccttattatttgagtttgatagaccccgagaatcctaattgtccgattcgtaaacaagccattcctactcaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagaaagatgcttcttctccttctgagcgcatcgatcgatgcattgagtatatagccaatacaccgacagtccgcgatgttttgctatcgggaggcgatgccctccttgtcagcgacgaacgcttggagtacatactgaagcgtctgcgcgaagtacctcatgtggagattgttcgtataggaagccgtgcgccggtagtcctccctcagcgcataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagcgattggtacatctgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgtggtatctcagtccccacgacatgtggttcttcgcaattatgaaggtgttatcacaacctatacggagccggaggactatcatgaggagtgcggttgtgaggactgccgagtcgacaagcatcgtgagggcgtggctgaactttccggaggtcagcagttggctctagagcctcccgacttagctcgcaaagaacgcaggttcgataagaactaa

SEQ ID NO: 4460 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECGCEDCRVDKHREGVAELSGGQQLALEPPDLARKERRFDKN

SEQ ID NO: 4461 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagagtcgcccaaagtactccgaatggctatcacgccttattatttgagtttgatagaccccgagaatcctaattgtccgattcgtaaacaagccattcctactcaacgggaactggtgcgtgctcctgaagatatggtagacccacttagtgaagatgaagattcgcccgtacccggactaactcatcgttatccggatcgtgtattgttccttatcacggacaaatgttcgatgtactgtcgtcattgtactcgccgtcgcttcgcgggacagaaagatgcttcttctccttctgagcgcatcgatcgatgcattgagtatatagccaatacaccgacagtccgcgatgttttgctatcgggaggtgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacgcatgtgatgaagagattggtacatctgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctgcctttgtggtacatgctccggggggtggtggtaagatacctgtagcgccgaactatgtggtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctctagagcctcccgacttagctcgcaaagaacgcaggagcgataagaactaa

SEQ ID NO: 4462 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPAFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4463 - DNA, 1251 bp, Artificial Sequence
  Description of Artificial Sequence: Synthetic Construct
atggcagaaagtcgtagaaagcattacttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgcataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctaccttcgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcggttgtgaggactgccgtgtcggcaagcataaagagggcgtggctgcactttccggaggtcagcagttggctttagagcctcccgacttagctcgcaaagaacgcaggttcgataagaactaa

SEQ ID NO: 4464 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECGCEDCRVGKHKEGVAALSGGQQLALEPPDLARKERRFDKN

SEQ ID NO: 4465 - DNA, 1251 bp, Artificial Sequence
  Description of Artificial Sequence: Synthetic Construct
atggcagaaagtcgtagaaagcattacttccctgatgtcaccgataagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactcaacgggaactggtgcgtgctcctgaagatatggtagacccacttagtgaagatgaagattcgcccgtacccggactaactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagcgattggtacatctgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgtcatgtggttcttcgcaattatgaaggtgttatcacaacctatacggagccggaggactatcatgaggagtgcgattgtgaggactgccgtgccgacaagcatcgtgagggcgtggctgcactttccggaggtcagcagttggctctagagcctcccgacttagctcgcaaagaacgcaggagcgataagaactaa

SEQ ID NO: 4466 - protein, 416 aa, Artificial Sequence
  Description of Artificial Sequence: Synthetic Construct
MAESRRKHYFPDVTDKQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRADKHREGVAALSGGQQLALEPPDLARKERRSDKN

SEQ ID NO: 4467 - DNA, 1251 bp, Artificial Sequence
  Description of Artificial Sequence: Synthetic Construct
atggcagaaagtcgtagaaagcattatttccctgatgtcaccgataagcaatggtacgactggcattggcaggtcatcaatcgaattaagacgctcgaccagctggagaagtacgttacactcaccgctgaagaagaagagggagtaaaagagtcgcccaaagtactccgaatggctatcacgccttattatttgagtttgatagaccccgagaatcctaattgtccgattcgtaaacaagccattcctactcaacgggaactggtgcgtgctcctgaagatatggtagacccacttagtgaagatgaagattcgcccgtacccggactaactcatcgttatccggatcgcgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatctgctggtaaagattcgtgtgcgtccttactacatatatgcttgcgatctttcgcctggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcggcaagcatcgtgagggcgtggctgcactttccggaggtcagcagttggctttagagcctcccgacttagctcgcaaagaacgcaggagcgataagaactaa

SEQ ID NO: 4468 - protein, 416 aa, Artificial Sequence
  Description of Artificial Sequence: Synthetic Construct
MAESRRKHYFPDVTDKQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSPGIGHFRTPVSKGIEIIENLRGHTSGYAVPTFVVHAPGGGGKIPVAPNYVVSQSPRHVVLRNYEGVITTYTEPEDYHEECDCEDCRVGKHREGVAALSGGQQLALEPPDLARKERRSDKN

SEQ ID NO: 4469 - DNA, 1251 bp, Artificial Sequence
  Description of Artificial Sequence: Synthetic Construct
atggcagaaagtcgtagaaagcattacttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtgcgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagaaagatgcttcttctccttctgagcgcatcgatcgatgcattgagtatatagccaatacaccgacagtccgcgatgttttgctatcgggaggcgatgccctccttgtcagcgacgaacgcttggagtacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacgcatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctaccttcgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgaactttccggaggtcagcagttggctttagagcctcccgacttagctcgcaaagaacgcaggttcgataagaactaa

SEQ ID NO: 4470 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAELSGGQQLALEPPDLARKERRFDKN

SEQ ID NO: 4471 - DNA, 1251 bp, Artificial Sequence
  Description of Artificial Sequence: Synthetic Construct
atggcagaaagtcgtagaaagcattacttccctgatgtcaccgatgagcaatggtacgactggcattggcaggtcatcaatcgaattaagacgctcgaccagctggagaagtacgttacactcaccgctgaagaagaagagggagtaaaagagtcgcccaaagtactccgaatggctatcacgccttattatttgagtttgatagaccccgagaatcctaattgtccgattcgtaaacaagccattcctactcaacgggaactggtgcgtgctcctgaagatatggtagacccacttagtgaagatgaagattcgcccgtacccggactaactcatcgttatccggatcgcgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggagtacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacgcatgtgatgaagagattggtacatctgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcggttgtgaggactgccgtgtcgacaagcatcgtgagggcgtggctgcactttccggaggtcagcagttggctctagagcctcccgactcagctcgcaaagaacgcaggttcgataagaactaa

SEQ ID NO: 4472 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECGCEDCRVDKHREGVAALSGGQQLALEPPDSARKERRFDKN

SEQ ID NO: 4473 - DNA, 1251 bp, Artificial Sequence
  Description of Artificial Sequence: Synthetic Construct
atggcagaaagtcgtagaaagcattatttccctgatgtcaccgataagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtgcgtgctcctgaagatatggtagacccacttagtgaagatgaagattcgcccgtacccggactaactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggtgatgccctccttgtcagcgacgaacgcttggagtacatactgaagcgtctgcgcgaagtacctcatgtggagattgttcgtataggaagccgtgcgccggtagtcctccctcagcgcataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacgcatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgtggtatctcagtccccacgacatgtggttcttcgcaattatgaaggtgttatcacaacctatacggagccggaggactatcatgaggagtgcggttgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4474 - protein, 416 aa, Artificial Sequence; identical to SEQ ID NO: 4356
  Description of Artificial Sequence: Synthetic Construct

SEQ ID NO: 4475 - DNA, 1251 bp, Artificial Sequence
  Description of Artificial Sequence: Synthetic Construct
atggcagaaagtcgtagaaagcattacttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtgcgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggtgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagcgattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctaccttcgtggtacatgctccggggggtggtggtaagatacctgtagcgccgaactatgttgtatctcagtccccacgtcatgtggttcttcgcaattatgaaggtgttatcacaacctatacggagccggaggactatcatgaggagtgcggttgtgaggactgccgagtcgacaagcatcgtgagggcgtggctgcactttccggaggtcagcagttggctctagagcctcccgacttagctcgcaaagaacgcaggttcgataagaactaa

SEQ ID NO: 4476 - protein, 416 aa, Artificial Sequence; identical to SEQ ID NO: 4424
  Description of Artificial Sequence: Synthetic Construct

SEQ ID NO: 4477 - DNA, 1251 bp, Artificial Sequence
  Description of Artificial Sequence: Synthetic Construct
atggcagaaagtcgtagaaagcattatttccctgatgtcaccgataagcaatggtacgactggcattggcaggtcatcaatcgaattaagacgctcgaccagctggagaagtacgttacactcaccgctgaagaagaagagggagtaaaagagtcgcccaaagtactccgaatggctatcacgccttattatttgagtttgatagaccccgagaatcctaattgtccgattcgtaaacaagccattcctactaaacgggaactggtgcgtgctcctgaagatatggtagacccacttagtgaagatgaagattcgcccgtacccggactaactcatcgttatccggatcgtgtattgttccttatcacggacaaatgttcgatgtactgtcgtcattgtactcgccgtcgcttcgcgggacagaaagatgcttcttctccttctgagcgcatcgatcgatgcattgagtatatagccaatacaccgacagtccgcgatgttttgctatcgggaggtgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgtgtcgacaagcataaagagggcgtggctacactttccggaggtcagcagttggctttagagcctcccgacttagctcgcaaagaacgcaggagcgataagaactaa

SEQ ID NO: 4478 - protein, 416 aa, Artificial Sequence
  Description of Artificial Sequence: Synthetic Construct
MAESRRKHYFPDVTDKQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHKEGVATLSGGQQLALEPPDLARKERRSDKN

SEQ ID NO: 4479 - DNA, 1251 bp, Artificial Sequence
  Description of Artificial Sequence: Synthetic Construct
atggcagaaagtcgtagaaagcattacttccctgatgtcaccgataagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtgcgtgctcctgaagatatggtagacccacttagtgaagatgaagattcgcccgtacccggactgactcatcgttatccggatcgcgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggtgatgccctccttgtcagcgacgaacgcttggagtacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatctgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctaccttcgtggtacatgctccggggggtggtggtaagatacctgtagcgccgaactatgtggtatctcagtccccacgacatgtggttcttcgcaattatgaaggtgttatcacaacctatacggagccggaggactatcatgaggagtgcgattgtgaggactgccgtgtcgacaagcataaagagggcgtggctgaactttccggaggtcagcagttggctttagagcctcccgacttagctcgcaaagaacgcaggagcgataagaactaa

SEQ ID NO: 4480 - protein, 416 aa, Artificial Sequence
  Description of Artificial Sequence: Synthetic Construct
MAESRRKHYFPDVTDKQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHKEGVAELSGGQQLALEPPDLARKERRSDKN

SEQ ID NO: 4481 - DNA, 1251 bp, Artificial Sequence
  Description of Artificial Sequence: Synthetic Construct
atggcagaaagtcgtagaaagcattacttccctgatgtcaccgatgagcaatggtacgactggcattggcaggtcatcaatcgaattaagacgctcgaccagctggagaagtacgttacactcaccgctgaagaagaagagggagtaaaagagtcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgtcctccttgtcagcgacgaacgcttggagtacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctaccttcgtggtacatgctccggggggtggtggtaagatacctgtagcgccgaactatgtggtatctcagtccccacgacatgtggttcttcgcaattatgaaggtgttatcacaacctatacggagccggaggactatcatgaggagtgcgattgtgaggactgccgtgccggcaagcatcgtgagggcgtggctgcactttccggaggtcagcagttggctctagagcctcccgacttagctcgcaaagaacgcaggagcgataagaactaa

SEQ ID NO: 4482 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDVLLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRAGKHREGVAALSGGQQLALEPPDLARKERRSDKN

SEQ ID NO: 4483 - DNA, 1251 bp, Artificial Sequence
  Description of Artificial Sequence: Synthetic Construct
atggcagaaagtcgtagaaagcattacttccctgatgtcaccgataagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactcaacgggaactggtgcgtgctcctgaagatatggtagacccacttagtgaagatgaagattcgcccgtacccggactaactcatcgttatccggatcgtgtattgttccttatcacggacaaatgttcgatgtactgtcgtcattgtactcgccgtcgcttcgcgggacagaaagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgcataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagcgattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgtcatgtggttcttcgcaattatgaaggtgttatcacaacctatacggagccggaggactatcatgaggagtgcgattgtgaggactgccgtgtcggcaagcataaagagggcgtggctacactttccggaggtcagcagttggctttagagcctcccgacttagctcgcaaagaacgcaggagcgataagaactaa

SEQ ID NO: 4484 - protein, 416 aa, Artificial Sequence
  Description of Artificial Sequence: Synthetic Construct
MAESRRKHYFPDVTDKQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVGKHKEGVATLSGGQQLALEPPDLARKERRSDKN

SEQ ID NO: 4485 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactcaacgggaactggtgcgtgctcctgaagatatggtagacccacttagtgaagatgaagattcgcccgtacccggactaactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatcccgtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagcgattggtacatctgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctaccttcgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4486 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4487 - DNA, 1251 bp, Artificial Sequence
  Description of Artificial Sequence: Synthetic Construct
atggcagaaagtcgtagaaagcattacttccctgatgtcaccgataagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactaactcatcgttatccggatcgcgtattgttccttatcacggacaaatgttcgatgtactgtcgtcattgtactcgccgtcgcttcgcgggacagaaagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagcgattggtacatctgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgtcatgtggttcttcgcaattatgaaggtgttatcacaacctatacggagccggaggactatcatgaggagtgcgattgtgaggactgccgagtcgacaagcatcgtgagggcgtggctgaactttccggaggtcagcagttggctctagagcctcccgacttagctcgcaaagaacgcaggagcgataagaactaa

SEQ ID NO: 4488 - protein, 416 aa, Artificial Sequence
  Description of Artificial Sequence: Synthetic Construct
MAESRRKHYFPDVTDKQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAELSGGQQLALEPPDLARKERRSDKN

SEQ ID NO: 4489 - DNA, 1251 bp, Artificial Sequence
  Description of Artificial Sequence: Synthetic Construct
atggcagaaagtcgtagaaagcattacttccctgatgtcaccgataagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtgcgtgctcctgaagatatggtagacccacttagtgaagatgaagattcgcccgtacccggactgactcatcgttatccggatcgcgtattgttccttatcacggacaaatgttcgatgtactgtcgtcattgtactcgccgtcgcttcgcgggacagaaagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgtgccggcaagcataaagagggcgtggctgcactttccggaggtcagcagttggctctagagcctcccgacttagctcgcaaagaacgcaggagcgataagaactaa

SEQ ID NO: 4490 - protein, 416 aa, Artificial Sequence
  Description of Artificial Sequence: Synthetic Construct
MAESRRKHYFPDVTDKQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRAGKHKEGVAALSGGQQLALEPPDLARKERRSDKN

SEQ ID NO: 4491 - DNA, 1251 bp, Artificial Sequence
  Description of Artificial Sequence: Synthetic Construct
atggcagaaagtcgtagaaagcattacttccctgatgtcaccgataagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactaactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggtgatgccctccttgtcagcgacgaacgcttggagtacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagcgattggtacatctgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctaccttcgtggtacatgctccggggggtggtggtaagatacctgtagcgccgaactatgtggtatctcagtccccacgacatgtggttcttcgcaattatgaaggtgttatcacaacctatacggagccggaggactatcatgaggagtgcggttgtgaggactgccgagtcgacaagcatcgtgagggcgtggctgcactttccggaggtcagcagttggctctagagcctcccgacttagctcgcaaagaacgcaggttcgataagaactaa

SEQ ID NO: 4492 - protein, 416 aa, Artificial Sequence
  Description of Artificial Sequence: Synthetic Construct
MAESRRKHYFPDVTDKQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECGCEDCRVDKHREGVAALSGGQQLALEPPDLARKERRFDKN

SEQ ID NO: 4493 - DNA, 1251 bp, Artificial Sequence
  Description of Artificial Sequence: Synthetic Construct
atggcagaaagtcgtagaaagcattacttccctgatgtcaccgataagcaatggtacgactggcattggcaggtcatcaatcgaattaagacgctcgaccagctggagaagtacgttacactcaccgctgaagaagaagagggagtaaaagagtcgcccaaagtactccgaatggctatcacgccttattatttgagtttgatagaccccgagaatcctaattgtccgattcgtaaacaagccattcctactaaacgggaactggtgcgtgctcctgaagatatggtagacccacttagtgaagatgaagattcgcccgtacccggactaactcatcgttatccggatcgtgtattgttccttatcacggacaaatgttcgatgtactgtcgtcattgtactcgccgtcgcttcgcgggacagaaagatgcttcttctccttctgagcgcatcgatcgatgcattgagtatatagccaatacaccgacagtccgcgatgttttgctatcgggaggtgatgccctccttgtcagcgacgaacgcttggagtacatactgaagcgtctgcgcgaagtacctcatgtggagattgttcgtataggaagccgtgcgccggtagtcctccctcagcgtataacgcctcaattggtggatatgctcaaaaaatatcatcccgtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagcgattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctaccttcgtggtacatgctccggggggtggtggtaagatacctgtagcgccgaactatgtggtatctcagtccccacgacatgtggttcttcgcaattatgaaggtgttatcacaacctatacggagccggaggactatcatgaggagtgcgattgtgaggactgccgagtcgacaagcatcgtgagggcgtggctgaactttccggaggtcagcagttggctttagagcctcccgacttagctcgcaaagaacgcaggttcgataagaactaa

SEQ ID NO: 4494 - protein, 416 aa, Artificial Sequence
  Description of Artificial Sequence: Synthetic Construct
MAESRRKHYFPDVTDKQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAELSGGQQLALEPPDLARKERRFDKN

SEQ ID NO: 4495 - DNA, 1251 bp, Artificial Sequence
  Description of Artificial Sequence: Synthetic Construct
atggcagaaagtcgtagaaagcattacttccctgatgtcaccgataagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggtgatgccctccttgtcagcgacgaacgcttggagtacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctaccttcgtggtacatgctccggggggtggtggtaagatacctgtagcgccgaactatgtggtatctcagtccccacgacatgtggttcttcgcaattatgaaggtgttatcacaacctatacggagccggaggactatcatgaggagtgcgattgtgaggactgccgagtcggcaagcatcgtgagggcgtggctgaactttccggaggtcagcagttggctttagagcctcccgacttagctcgcaaagaacgcaggttcgataagaactaa

SEQ ID NO: 4496 - protein, 416 aa, Artificial Sequence
  Description of Artificial Sequence: Synthetic Construct
MAESRRKHYFPDVTDKQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVGKHREGVAELSGGQQLALEPPDLARKERRFDKN

SEQ ID NO: 4497 - DNA, 1251 bp, Artificial Sequence
  Description of Artificial Sequence: Synthetic Construct
atggcagaaagtcgtagaaagcattacttccctgatgtcaccgatgagcaatggtacgactggcattggcaggtcatcaatcgaattaagacgctcgaccagctggagaagtacgttacactcaccgctgaagaagaagagggagtaaaagagtcgcccaaagtactccgaatggctatcacgccttattatttgagtttgatagaccccgagaatcctaattgtccgattcgtaaacaagccattcctactaaacgggaactggtgcgtgctcctgaagatatggtagacccacttagtgaagatgaagattcgcccgtacccggactgactcatcgttatccggatcgcgtattgttccttatcacggacaaatgttcgatgtactgtcgtcattgtactcgccgtcgcttcgcgggacagaaagatgcttcttctccttctgagcgcatcgatcgatgcattgagtatatagccactacaccgacagtccgcgatgttttgctatcgggaggcgatgccctccttgtcagcgacgaacgcttggagtacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaatcggttttattgcgtggaatcaatgattgtacgcatgtgatgaagcgattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctaccttcgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcggttgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4498 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQKDASSPSERIDRCIEYIATTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQSVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECGCEDCRVDKHREGVAALSGGQQLALEPPDLARKERRSDKN

SEQ ID NO: 4499 - DNA, 1251 bp, Artificial Sequence
  Description of Artificial Sequence: Synthetic Construct
atggcagaaagtcgtagaaagcattacttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtgcgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagaaagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgcataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatctgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgtcatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaagttcgataagaactaa

SEQ ID NO: 4500 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERKFDKN

SEQ ID NO: 4501 - DNA, 1251 bp, Artificial Sequence
  Description of Artificial Sequence: Synthetic Construct
atggcagaaagtcgtagaaagcattacttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactcaacgggaactggtacgtgctcctgaagatatggtagacccacttagtgaagatgaagattcgcccgtacccggactaactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggagtacatactgaagcgtctgcgcgaagtacctcatgtggagattgttcgtataggaagccgtgcgccggtagtcctccctcagcgtataacgcctcaattggtggatatgctcaaaaaatatcatcccgtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgtggtatctcagtccccacgacatgtggttcttcgcaattatgaaggtgttatcacaacctatacggagccggaggactatcatgaggagtgcgattgtgaggactgccgtgtcggcaagcatcgtgagggcgtggctacactttccggaggtcagcagttggctttagagcctcccgacttagctcgcaaagaacgcaggttcgataagaactaa

SEQ ID NO: 4502 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTQRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVGKHREGVATLSGGQQLALEPPDLARKERRFDKN

SEQ ID NO: 4503 - DNA, 1251 bp, Artificial Sequence
  Description of Artificial Sequence: Synthetic Construct
atggcagaaagtcgtagaaagcattacttccctgatgtcaccgataagcaatggtacgactggcattggcaggtcatcaatcgaattaagacgctcgaccagctggagaagtacgttacactcaccgctgaagaagaagagggagtaaaagagtcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactaactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggagtacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttgccgaagaagcagtggaggcttgtgaaagaatggccaatgccggtattccgttgggtaaccaaacggttttattgcgtggaatcaatgattgtacacatgtgatgaagagattggtacatctgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcggcaagcatcgtgagggcgtggctgcactttccggaggtcagcagttggctttagagcctcccgacttagctcgcaaagaacgcaggagcgataagaactaa

SEQ ID NO: 4504 - protein, 416 aa, Artificial Sequence
  Description of Artificial Sequence: Synthetic Construct
MAESRRKHYFPDVTDKQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVAEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVGKHREGVAALSGGQQLALEPPDLARKERRSDKN

SEQ ID NO: 4505 - DNA, 1251 bp, Artificial Sequence
  Description of Artificial Sequence: Synthetic Construct
atggcagaaagtcgtagaaagcattacttccctgatgtcaccgataagcaatggtacgactggcattggcaggtcatcaatcgaattaagacgctcgaccagctggagaagtacgttacactcaccgctgaagaagaagagggagtaaaagagtcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgcataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgtggtatctcagtccccacgacatgtggttcttcgcaattatgaaggtgttatcacaacctatacggagccggaggactatcatgaggagtgcggttgtgaggactgccgagtcgacaagcatcgtgagggcgtggctgcactttccggaggtcagcagttggctttagagcctcccgacttagctcgcaaagaacgcaggttcgataagaactaa

SEQ ID NO: 4506 - protein, 416 aa, Artificial Sequence; identical to SEQ ID NO: 4492
  Description of Artificial Sequence: Synthetic Construct

SEQ ID NO: 4507 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtgtaggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacgtatatgcttgcgatctttcgcttggaatagggcatttccgcacgccggtatccaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccaacttagctcgcaaagaacgcaggagcgataagaactaa

SEQ ID NO: 4508 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRVGSRAPVVLPQRITPQLVDMLKKYHPVWLNTHFNHPNEVTEEAVEACERMANAGIPLGNQTVLLRGINDCTHVMKRLVHLLVKIRVRPYYVYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPNLARKERRSDKN

SEQ ID NO: 4509 - DNA, 1251 bp, Artificial Sequence
  Description of Artificial Sequence: Synthetic Construct
atggcagaatgtcgtagagagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgctctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatggcggtattccgttgggtaaccaaacggttttattgcgtggaatcaatgattgtacacatgtgatgaagagattggtacatttgctggtaaagattcgtgtgcgtccttactacgtatatgcttgcgatctttcgcttggaatagggcatttccgcacgccggtatctaagggagtcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccaacttagctcgcaaagaacgcaggagcgataggaactaa

SEQ ID NO: 4510 - protein, 416 aa, Artificial Sequence
  Description of Artificial Sequence: Synthetic Construct
MAECRREHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANGGIPLGNQTVLLRGINDCTHVMKRLVHLLVKIRVRPYYVYACDLSLGIGHFRTPVSKGVEIIENLRGHTSGYAVPTFVVHAPGGGGKIPVAPNYVVSQSPRHVVLRNYEGVITTYTEPEDYHEECDCEDCRVDKHREGVAALSGGQQLALEPPNLARKERRSDRN

SEQ ID NO: 4511 - DNA, 1251 bp, Artificial Sequence
  Description of Artificial Sequence: Synthetic Construct
atggcagaaagtcgtagagagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtgtaggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacgtatatgcttgcgatctttcgcttggaatagggcatttccgcacgccggtatctaagggagtcgaaattatcgaaaatttgcgcggacacacctcgggctatgcagttcctacctttgtggtacatgctgcggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataggaactaa

SEQ ID NO: 4512 - protein, 416 aa, Artificial Sequence
  Description of Artificial Sequence: Synthetic Construct
MAESRREHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRVGSRAPVVLPQRITPQLVDMLKKYHPVWLNTHFNHPNEVTEEAVEACERMANAGIPLGNQTVLLRGINDCTHVMKRLVHLLVKIRVRPYYVYACDLSLGIGHFRTPVSKGVEIIENLRGHTSGYAVPTFVVHAAGGGGKIPVAPNYVVSQSPRHVVLRNYEGVITTYTEPEDYHEECDCEDCRVDKHREGVAALSGGQQLALEPPDLARKERRSDRN

SEQ ID NO: 4513 - DNA, 1251 bp, Artificial Sequence
  Description of Artificial Sequence: Synthetic Construct
atggcagaatgtcgtagagagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtgtaggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacgtatatgcttgcgatctttcgcttggaatagggcatttccgcacgccggtatctaagggagtcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataggaactaa

SEQ ID NO: 4514 - protein, 416 aa, Artificial Sequence
  Description of Artificial Sequence: Synthetic Construct
MAECRREHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRVGSRAPVVLPQRITPQLVDMLKKYHPVWLNTHFNHPNEVTEEAVEACERMANAGIPLGNQTVLLRGINDCTHVMKRLVHLLVKIRVRPYYVYACDLSLGIGHFRTPVSKGVEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDRN

SEQ ID NO: 4515 - DNA, 1251 bp, Artificial Sequence
  Description of Artificial Sequence: Synthetic Construct
atggcagaaagtcgtagagagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtgtaggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggtcaatgccggtattccgttgggtaaccaaacggttttattgcgtggaatcaatgattgtacacatgtgatgaagagattggtacatttgctggtaaagattcgtgtgcgtccttactacgtatatgcttgcgatctttcgcttggaatagggcattaccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccaacttagctcgcaaagaacgcaggagcgataggaactaa

SEQ ID NO: 4516 - protein, 416 aa, Artificial Sequence
  Description of Artificial Sequence: Synthetic Construct
MAESRREHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRVGSRAPVVLPQRITPQLVDMLKKYHPVWLNTHFNHPNEVTEEAVEACERMVNAGIPLGNQTVLLRGINDCTHVMKRLVHLLVKIRVRPYYVYACDLSLGIGHYRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPNLARKERRSDRN

SEQ ID NO: 4517 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtgtaggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacgtatatgcttgcgatctttcgcttggaatagggcatttccgcacgccggtatctaagggagtcgaaattatcgaaaacttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataggaactaa

SEQ ID NO: 4518 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRVGSRAPVVLPQRITPQLVDMLKKYHPVWLNTHFNHPNEVTEEAVEACERMANAGIPLGNQTVLLRGINDCTHVMKRLVHLLVKIRVRPYYVYACDLSLGIGHFRTPVSKGVEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDRN

SEQ ID NO: 4519 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgccagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatggcggtattccgttgggtaaccaaacggttttattgcgtggaatcaatgattgtacacatgtgatgaagagattggtacatttgctggtaaagattcgtgtgcgtccttactacgtatatgcttgcgatctttcgcttggaatagggcatttccgcacgccggtatctaagggaatcgaaattatcgaaaatttgcgcggacacacctcgggctgtgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccaacttagctcgcaaagaacgcaggagcgataggaactaa

SEQ ID NO: 4520 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLASDERLEYILKRLREVPHVEIVRIGSRAPVVLPQRITPQLVDMLKKYHPVWLNTHFNHPNEVTEEAVEACERMANGGIPLGNQTVLLRGINDCTHVMKRLVHLLVKIRVRPYYVYACDLSLGIGHFRTPVSKGIEIIENLRGHTSGCAVPTFVVHAPGGGGKIPVAPNYVVSQSPRHVVLRNYEGVITTYTEPEDYHEECDCEDCRVDKHREGVAALSGGQQLALEPPNLARKERRSDRN

SEQ ID NO: 4521 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgccagcgacgaacgcttggaatacatactgaagcgtctgcgcgaagtacctcatgtggagattgttcgtgtaggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacgtatatgcttgcgatctttcgcttggaatagggcatttccgcacgccggtatctaagggaatcgaaattatcgaaaatttgcgcggacacacctcgggctgtgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcggttgtgaggactgccgagccgacaagcatcgtgagggcgtggctgcactttccggaggtcagcagttggctttagagcctcccaacttagctcgcaaagaacgcaggagcgataagaactaa

SEQ ID NO: 4522 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLASDERLEYILKRLREVPHVEIVRVGSRAPVVLPQRITPQLVDMLKKYHPVWLNTHFNHPNEVTEEAVEACERMANAGIPLGNQTVLLRGINDCTHVMKRLVHLLVKIRVRPYYVYACDLSLGIGHFRTPVSKGIEIIENLRGHTSGCAVPTFVVHAPGGGGKIPVAPNYVVSQSPRHVVLRNYEGVITTYTEPEDYHEECGCEDCRADKHREGVAALSGGQQLALEPPNLARKERRSDKN

SEQ ID NO: 4523 - DNA, 1251 bp, Artificial Sequence
  Description of Artificial Sequence: Synthetic Construct
atggcagaaagtcgtagagagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtgtaggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacgtatatgcttgcgatctttcgcttggaatagggcatttccgcacgccggtatctaagggagtcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccaacttagctcgcaaagaacgcaggagcgataggaactaa

SEQ ID NO: 4524 - protein, 416 aa, Artificial Sequence
  Description of Artificial Sequence: Synthetic Construct
MAESRREHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRVGSRAPVVLPQRITPQLVDMLKKYHPVWLNTHFNHPNEVTEEAVEACERMANAGIPLGNQTVLLRGINDCTHVMKRLVHLLVKIRVRPYYVYACDLSLGIGHFRTPVSKGVEIIENLRGHTSGYAVPTFVVHAPGGGGKIPVAPNYVVSQSPRHVVLRNYEGVITTYTEPEDYHEECDCEDCRVDKHREGVAALSGGQQLALEPPNLARKERRSDRN

SEQ ID NO: 4525 - DNA, 1251 bp, Artificial Sequence
  Description of Artificial Sequence: Synthetic Construct
atggcagaaagtcgtagagagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtgtaggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatggcggtattccgttgggtaaccaaacggttttattgcgtggaatcaatgattgtacacatgtgatgaagagattggtacatttgctggtaaagattcgtgtgcgtccttactacgtatatgcttgcgatctttcgcttggaatagggcatttccgcacgccggtatctaagggagtcgaaattatcgagaatttgcgcggacacacctcgggctatgcagttcctacctttgtggtacatgctgcggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccaacttagctcgcaaagaacgcaggagcgataagaactaa

SEQ ID NO: 4526 - protein, 416 aa, Artificial Sequence
  Description of Artificial Sequence: Synthetic Construct
MAESRREHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRVGSRAPVVLPQRITPQLVDMLKKYHPVWLNTHFNHPNEVTEEAVEACERMANGGIPLGNQTVLLRGINDCTHVMKRLVHLLVKIRVRPYYVYACDLSLGIGHFRTPVSKGVEIIENLRGHTSGYAVPTFVVHAAGGGGKIPVAPNYVVSQSPRHVVLRNYEGVITTYTEPEDYHEECDCEDCRVDKHREGVAALSGGQQLALEPPNLARKERRSDKN

SEQ ID NO: 4527 - DNA, 1251 bp, Artificial Sequence
  Description of Artificial Sequence: Synthetic Construct
atggcagaatgtcgtagagagcattatttccctgatgtcaccgatgagcagtggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgccagcgacgaacgcttggaatacatactgaagcgtctgcgcgaagtacctcatgtggagattgttcgtgtaggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggagtcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccaacttagctcgcaaagaacgcaggagcgataagaactaa

SEQ ID NO: 4528 - protein, 416 aa, Artificial Sequence
  Description of Artificial Sequence: Synthetic Construct
MAECRREHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLASDERLEYILKRLREVPHVEIVRVGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGVEIIENLRGHTSGYAVPTFVVHAPGGGGKIPVAPNYVVSQSPRHVVLRNYEGVITTYTEPEDYHEECDCEDCRVDKHREGVAALSGGQQLALEPPNLARKERRSDKN

SEQ ID NO: 4529 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcattaccgcacgccggtatctaagggaaccgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccaacttagctcgcaaagaacgcaggagcgataagaactaa

SEQ ID NO: 4530 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHYRTPVSKGTEIIENLRGHTSGYAVPTFVVHAPGGGGKIPVAPNYVVSQSPRHVVLRNYEGVITTYTEPEDYHEECDCEDCRVDKHREGVAALSGGQQLALEPPNLARKERRSDKN

SEQ ID NO: 4531 - DNA, 1251 bp, Artificial Sequence
  Description of Artificial Sequence: Synthetic Construct
atggcagaaagtcgtagagagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcaccgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtgtaggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacgtatatgcttgcgatctttcgcttggaatagggcattaccgcacgccggtatctaagggaatcgaaattatcgaaaatttgcgcggacacacctcgggctgtgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataggaactaa

SEQ ID NO: 4532 - protein, 416 aa, Artificial Sequence
  Description of Artificial Sequence: Synthetic Construct
MAESRREHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRVGSRAPVVLPQRITPQLVDMLKKYHPVWLNTHFNHPNEVTEEAVEACERMANAGIPLGNQTVLLRGINDCTHVMKRLVHLLVKIRVRPYYVYACDLSLGIGHYRTPVSKGIEIIENLRGHTSGCAVPTFVVHAPGGGGKIPVAPNYVVSQSPRHVVLRNYEGVITTYTEPEDYHEECDCEDCRVDKHREGVAALSGGQQLALEPPDLARKERRSDRN

SEQ ID NO: 4533 - DNA, 1251 bp, Artificial Sequence
  Description of Artificial Sequence: Synthetic Construct
atggcagaatgtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgccagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacgtatatgcttgcgatctttcgcttggaatagggcattaccgcacgccggtatctaagggagtcgaaattatcgaaaatttgcgcggacacacctcgggctgtgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccaacttagctcgcaaagaacgcaggagcgataggaactaa

SEQ ID NO: 4534 - protein, 416 aa, Artificial Sequence
  Description of Artificial Sequence: Synthetic Construct
MAECRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLASDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYVYACDLSLGIGHYRTPVSKGVEIIENLRGHTSGCAVPTFVVHAPGGGGKIPVAPNYVVSQSPRHVVLRNYEGVITTYTEPEDYHEECDCEDCRVDKHREGVAALSGGQQLALEPPNLARKERRSDRN

SEQ ID NO: 4535 - DNA, 1251 bp, Artificial Sequence
  Description of Artificial Sequence: Synthetic Construct
atggcagaatgtcgtagagagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagggatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtgtaggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacgtatatgcttgcgatctttcgcttggaatagggcatttccgcacgccggtatctaagggagtcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccaacttagctcgcaaagaacacaggagcgataggaactaa

SEQ ID NO: 4536 - protein, 416 aa, Artificial Sequence
  Description of Artificial Sequence: Synthetic Construct
MAECRREHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRVGSRAPVVLPQRITPQLVDMLKKYHPVWLNTHFNHPNEVTEEAVEACERMANAGIPLGNQTVLLRGINDCTHVMKRLVHLLVKIRVRPYYVYACDLSLGIGHFRTPVSKGVEIIENLRGHTSGYAVPTFVVHAPGGGGKIPVAPNYVVSQSPRHVVLRNYEGVITTYTEPEDYHEECDCEDCRVDKHREGVAALSGGQQLALEPPNLARKEHRSDRN

SEQ ID NO: 4537 - DNA, 1251 bp, Artificial Sequence
  Description of Artificial Sequence: Synthetic Construct
atggcagaaagtcgtagagagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtgtaggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacgtatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4538 - protein, 416 aa, Artificial Sequence
  Description of Artificial Sequence: Synthetic Construct
MAESRREHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRVGSRAPVVLPQRITPQLVDMLKKYHPVWLNTHFNHPNEVTEEAVEACERMANAGIPLGNQTVLLRGINDCTHVMKRLVHLLVKIRVRPYYVYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4539 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtgtaggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatggcggtattccgttgggtaaccaaacggttttattgcgtggaatcaatgattgtacacatgtgatgaagagattggtacatttgctggtaaagattcgtgtgcgtccttactacgtatatgcttgcgatctttcgcttggaatagggcatttccgcacgccggtatctaagggagtcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccaacttagctcgcaaagaacgcaggagcgataagaactaa

SEQ ID NO: 4540 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRVGSRAPVVLPQRITPQLVDMLKKYHPVWLNTHFNHPNEVTEEAVEACERMANGGIPLGNQTVLLRGINDCTHVMKRLVHLLVKIRVRPYYVYACDLSLGIGHFRTPVSKGVEIIENLRGHTSGYAVPTFVVHAPGGGGKIPVAPNYVVSQSPRHVVLRNYEGVITTYTEPEDYHEECDCEDCRVDKHREGVAALSGGQQLALEPPNLARKERRSDKN

SEQ ID NO: 4541 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacgtatatgcttgcgatctttcgcttggaatagggcattaccgcacgccggtatctaagggaatcgaaattatcgaaaatttgcgcggacacacctcgggctgtgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggccgcactttccggaggtcagcagttggctttagagcctcccgacttagctcgcaaagaacgcaggagcgataagaactaa

SEQ ID NO: 4542 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYVYACDLSLGIGHYRTPVSKGIEIIENLRGHTSGCAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4543 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtgtaggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgaaggcgtggctgcactttccggaggtcagcagttggctttagagcctcccaacttagctcgcaaagaacgcaggagcgataagaactaa

SEQ ID NO: 4544 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRVGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPNLARKERRSDKN

SEQ ID NO: 4545 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtgtaggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggagtcgaaattatcgaaaatttgcgcggacacacctcgggctgtgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataggaactaa

SEQ ID NO: 4546 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRVGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGVEIIENLRGHTSGCAVPTFVVHAPGGGGKIPVAPNYVVSQSPRHVVLRNYEGVITTYTEPEDYHEECDCEDCRVDKHREGVAALSGGQQLALEPPDLARKERRSDRN

SEQ ID NO: 4547 - DNA, 1251 bp, Artificial Sequence
  Description of Artificial Sequence: Synthetic Construct
atggcagaaagtcgtagagagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaaccgaaattatcgaaaatttgcgcggacacacctcgggctgtgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataggaactaa

SEQ ID NO: 4548 - protein, 416 aa, Artificial Sequence
  Description of Artificial Sequence: Synthetic Construct
MAESRREHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGTEIIENLRGHTSGCAVPTFVVHAPGGGGKIPVAPNYVVSQSPRHVVLRNYEGVITTYTEPEDYHEECDCEDCRVDKHREGVAALSGGQQLALEPPDLARKERRSDRN

SEQ ID NO: 4549 - DNA, 1251 bp, Artificial Sequence
  Description of Artificial Sequence: Synthetic Construct
atggcagaaagtcgtagagagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatggcggtattccgttgggtaaccaaacggttttattgcgtggaatcaatgattgtacacatgtgatgaagagattggtacatttgctggtaaagattcgtgtgcgtccttactacgtatatgcttgcgatctttcgcttggaatagggcatttccgcacgccggtatctaagggaatcgaaattatcgaaaatttgcgcggacacacctcgggctgtgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccaacttagctcgcaaagaacgcaggagcgataagaactaa

SEQ ID NO: 4550 - protein, 416 aa, Artificial Sequence
  Description of Artificial Sequence: Synthetic Construct
MAESRREHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANGGIPLGNQTVLLRGINDCTHVMKRLVHLLVKIRVRPYYVYACDLSLGIGHFRTPVSKGIEIIENLRGHTSGCAVPTFVVHAPGGGGKIPVAPNYVVSQSPRHVVLRNYEGVITTYTEPEDYHEECDCEDCRVDKHREGVAALSGGQQLALEPPNLARKERRSDKN

SEQ ID NO: 4551 - DNA, 1251 bp, Artificial Sequence
  Description of Artificial Sequence: Synthetic Construct
atggcagaatgtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctcccccagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacgtatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcggtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccaacttagctcgcaaagaacgcaggagcgataggaactaa

SEQ ID NO: 4552 - protein, 416 aa, Artificial Sequence
  Description of Artificial Sequence: Synthetic Construct
MAECRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYVYACDLSLGIGHFRTPVSKGIEIIENLRGHTSGYAVPTFVVHAPGGGGKIPVAPNYVVSRSPRHVVLRNYEGVITTYTEPEDYHEECDCEDCRVDKHREGVAALSGGQQLALEPPNLARKERRSDRN

SEQ ID NO: 4553 - DNA, 1251 bp, Artificial Sequence
  Description of Artificial Sequence: Synthetic Construct
atggcagaatgtcgtagagagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtgtaggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcattaccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataggaactaa

SEQ ID NO: 4554 - protein, 416 aa, Artificial Sequence
  Description of Artificial Sequence: Synthetic Construct
MAECRREHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRVGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHYRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDRN

SEQ ID NO: 4555 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgccagcgacgaacgcttggaatacatactgaagcgtctgcgcgaagtacctcatgtggagattgttcgtgtaggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacgtatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccaacttagctcgcaaagaacgcaggagcgataagaactaa

SEQ ID NO: 4556 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLASDERLEYILKRLREVPHVEIVRVGSRAPVVLPQRITPQLVDMLKKYHPVWLNTHFNHPNEVTEEAVEACERMANAGIPLGNQTVLLRGINDCTHVMKRLVHLLVKIRVRPYYVYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPNLARKERRSDKN

SEQ ID NO: 4557 - DNA, 1251 bp, Artificial Sequence
  Description of Artificial Sequence: Synthetic Construct
atggcagaatgtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagggagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcagttggtggatatgctcaaaaaatatcatccggtgtggctgaacactcacttcaaccacccgaatgaagttaccgaagaagcagtggaggcttgtgaaagaatggccaatggcggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcattaccgcacgccggtatctaagggagtcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccaacttagctcgcaaagaacgcaggagcgataagaactaa

SEQ ID NO: 4558 - protein, 416 aa, Artificial Sequence
  Description of Artificial Sequence: Synthetic Construct
MAECRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQGDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANGGIPLGNQTVLLRGINDCTHVMKRLVHLLVKIRVRPYYIYACDLSLGIGHYRTPVSKGVEIIENLRGHTSGYAVPTFVVHAPGGGGKIPVAPNYVVSQSPRHVVLRNYEGVITTYTEPEDYHEECDCEDCRVDKHREGVAALSGGQQLALEPPNLARKERRSDKN

SEQ ID NO: 4559 - DNA, 1251 bp, Artificial Sequence
  Description of Artificial Sequence: Synthetic Construct
atggcagaaagtcgtagagagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgccagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatggcggtattccgttgggtaaccaaacggttttattgcgtggaatcaatgattgtacacatgtgatgaagagattggtacatttgctggtaaagattcgtgtgcgtccttactacgtatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4560 - protein, 416 aa, Artificial Sequence
  Description of Artificial Sequence: Synthetic Construct
MAESRREHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLASDERLEYILKRLREVPHVEIVRIGSRAPVVLPQRITPQLVDMLKKYHPVWLNTHFNHPNEVTEEAVEACERMANGGIPLGNQTVLLRGINDCTHVMKRLVHLLVKIRVRPYYVYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4561 - DNA, 1251 bp, Artificial Sequence
  Description of Artificial Sequence: Synthetic Construct
atggcagaatgtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcacgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggagtcgaaattatcgaaaatttgcgcggacacacctcgggctatgcagttcctacctttgtggtacatgctccagggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4562 - protein, 416 aa, Artificial Sequence
  Description of Artificial Sequence: Synthetic Construct
MAECRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGVEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4563 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggggtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtgtaggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctgcggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4564 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRVGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAAGGGGKIPVAPNYVVSQSPRHVVLRNYEGVITTYTEPEDYHEECDCEDCRVDKHREGVAALSGGQQLALEPPDLARKERRSDKN

SEQ ID NO: 4565 - DNA, 1251 bp, Artificial Sequence
  Description of Artificial Sequence: Synthetic Construct
atggcagaatgtcgtagagagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggcaatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacgtatatgcttgcgatctttcgcttggaatagggcatttccgcacgccggtatctaagggagtcgaaattatcgaaaatttgcgcggacacacctcgggctatgcagttcctacctttgtggtacatgctgcggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccaacttagctcgcaaagaacgcaggagcgataagaactaa

SEQ ID NO: 4566 - protein, 416 aa, Artificial Sequence
  Description of Artificial Sequence: Synthetic Construct
MAECRREHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYVYACDLSLGIGHFRTPVSKGVEIIENLRGHTSGYAVPTFVVHAAGGGGKIPVAPNYVVSQSPRHVVLRNYEGVITTYTEPEDYHEECDCEDCRVDKHREGVAALSGGQQLALEPPNLARKERRSDKN

SEQ ID NO: 4567 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtgtaggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggagtcgaaattatcgaaaatttgcgcggacacacctcgggctatgcagttcctacctttgtggtacatgctgcggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4568 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRVGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGVEIIENLRGHTSGYAVPTFVVHAAGGGGKIPVAPNYVVSQSPRHVVLRNYEGVITTYTEPEDYHEECDCEDCRVDKHREGVAALSGGQQLALEPPDLARKERRSDKN

SEQ ID NO: 4569 - DNA, 1251 bp, Artificial Sequence
  Description of Artificial Sequence: Synthetic Construct
atggcagaatgtcgtagagagcattatttccccgatgtcaccgatgagcaatggtacgactggcattggcaggtcatcaatcgaattaagacgctcgaccagctggagaagtacgttacactcaccgctgaagaagaagagggagtaaaggaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgccagcgacgaacgcttggaatacatactgaagcgtctgcgcgaagtacctcatgtggagattgttcgtgtaggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacgtatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccaacttagctcgcaaagaacgcaggagcgataagaactaa

SEQ ID NO: 4570 - protein, 416 aa, Artificial Sequence
  Description of Artificial Sequence: Synthetic Construct
MAECRREHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLASDERLEYILKRLREVPHVEIVRVGSRAPVVLPQRITPQLVDMLKKYHPVWLNTHFNHPNEVTEEAVEACERMANAGIPLGNQTVLLRGINDCTHVMKRLVHLLVKIRVRPYYVYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPNLARKERRSDKN

SEQ ID NO: 4571 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtgtaggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacgtatatgcttgcgatctttcgcttggaatagggcatttccgcacgccggtatctaagggagtcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataggaactaa

SEQ ID NO: 4572 - protein, 416 aa, Artificial Sequence; identical to SEQ ID NO: 4518
  Description of Artificial Sequence: Synthetic Construct

SEQ ID NO: 4573 - DNA, 1251 bp, Artificial Sequence
  Description of Artificial Sequence: Synthetic Construct
atggcagaatgtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgccagcgacgaacgcttggaatacatactgaagcgtctgcgcgaagtacctcatgtggagattgttcgtgtaggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacgtatatgcttgcgatctttcgcttggaatagggcatttccgcacgccggtatctaagggagtcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccaacttagctcgcaaagaacgcaggagcgataagaactaa

SEQ ID NO: 4574 - protein, 416 aa, Artificial Sequence
  Description of Artificial Sequence: Synthetic Construct
MAECRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLASDERLEYILKRLREVPHVEIVRVGSRAPVVLPQRITPQLVDMLKKYHPVWLNTHFNHPNEVTEEAVEACERMANAGIPLGNQTVLLRGINDCTHVMKRLVHLLVKIRVRPYYVYACDLSLGIGHFRTPVSKGVEIIENLRGHTSGYAVPTFVVHAPGGGGKIPVAPNYVVSQSPRHVVLRNYEGVITTYTEPEDYHEECDCEDCRVDKHREGVAALSGGQQLALEPPNLARKERRSDKN

SEQ ID NO: 4575 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatggcggtattccgttgggtaaccaaacggttttattgcgtggaatcaatgattgtacacatgtgatgaagagattggtacatttgctggtaaagattcgtgtgcgtccttactacgtatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4576 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANGGIPLGNQTVLLRGINDCTHVMKRLVHLLVKIRVRPYYVYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4577 - DNA, 1251 bp, Artificial Sequence
  Description of Artificial Sequence: Synthetic Construct
atggcagaatgtcgtagagagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccaaatgaagttaccgaagaagcagtggaggcttgtgaaagaatggccaatggcggtattccgttgggtaaccaaacggttttattgcgtggaatcaatgattgtacacatgtgatgaagagattggtacatttgctggtaaagattcgtgtgcgtccttactacgtatatgcttgcgatctttcgcttggaatagggcatttccgcacgccggtatctaagggaaccgaaattatcgaaaatttgcgcggacacacctcgggctatgcagttcctacctttgtggtacatgctgcggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccaacttagctcgcaaagaacgcaggagcgataagaactaa

SEQ ID NO: 4578 - protein, 416 aa, Artificial Sequence
  Description of Artificial Sequence: Synthetic Construct
MAECRREHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANGGIPLGNQTVLLRGINDCTHVMKRLVHLLVKIRVRPYYVYACDLSLGIGHFRTPVSKGTEIIENLRGHTSGYAVPTFVVHAAGGGGKIPVAPNYVVSQSPRHVVLRNYEGVITTYTEPEDYHEECDCEDCRVDKHREGVAALSGGQQLALEPPNLARKERRSDKN

SEQ ID NO: 4579 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggaggttgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatgtatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4580 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEVVRIGSRAPVVLPQRITPQLVDMLKKYHPVWLNTHFNHPNEVTEEAVEACERMANAGIPLGNQTVLLRGINDCTHVMKRLVHLLVKIRVRPYYMYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4581 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgagttaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaaaaatggccaatgccggtattccgttgggtaaccaaacggttttattgcgtggagtcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4582 - protein, 416 aa, Artificial Sequence
  Description of Artificial Sequence: Synthetic Construct
MAESRRKHYFPDVTDEQWYDWHWQVINRVKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACEKMANAGIPLGNQTVLLRGVNDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4583 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaactctcacttcaaccacccgaatgaagttaccgaagaagcagtggaggcttgtgaaaaaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4584 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNSHFNHPNEVTEEAVEACEKMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4585 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgagttaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggaggttgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaaaaatggccaatgccggtattccgttgggtaaccaaacggttttattgcgtggagtcaatgattgtacacatgtgatgaagagattggtacatttgctggtaaagattcgtgtgcgtccttactacatgtatgcttgcgatctttcgcttggaatagggcatttccgcacgccggtatctaagggaatcgaaattatcgaaaatttgcgcggacacacctcgggctatgcagttcctacctttgtggtacacgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4586 - protein, 416 aa, Artificial Sequence
  Description of Artificial Sequence: Synthetic Construct
MAESRRKHYFPDVTDEQWYDWHWQVINRVKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEVVRIGSRAPVVLPQRITPQLVDMLKKYHPVWLNTHFNHPNEVTEEAVEACEKMANAGIPLGNQTVLLRGVNDCTHVMKRLVHLLVKIRVRPYYMYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4587 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgagtggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggaggttgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaaaaatggccaatgccggtattccgttgggtaaccaaacggttttattgcgtggaatcaatgattgtacacatgtgatgaagagattggtacatttgctggtaaagatacgtgtgcgtccttactacatgtatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4588 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRVAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEVVRIGSRAPVVLPQRITPQLVDMLKKYHPVWLNTHFNHPNEVTEEAVEACEKMANAGIPLGNQTVLLRGINDCTHVMKRLVHLLVKIRVRPYYMYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4589 - DNA, 1251 bp, Artificial Sequence
  Description of Artificial Sequence: Synthetic Construct
atggcagaaagtcgtagaaagcattatttccctgatgtcaccaatgagcaatggtacgactggcattggcaggtcatcaatcgagttaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggaggttgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaaaaatggccaatgccggtattccgttgggtaaccaaacggttttattgcgtggagtcaatgattgtacacatgtgatgaagagattggtacatttgctggtaaagattcgtgtgcgtccttactacatgtatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4590 - protein, 416 aa, Artificial Sequence
  Description of Artificial Sequence: Synthetic Construct
MAESRRKHYFPDVTNEQWYDWHWQVINRVKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEVVRIGSRAPVVLPQRITPQLVDMLKKYHPVWLNTHFNHPNEVTEEAVEACEKMANAGIPLGNQTVLLRGVNDCTHVMKRLVHLLVKIRVRPYYMYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4591 - DNA, 1251 bp, Artificial Sequence
  Description of Artificial Sequence: Synthetic Construct
atggcagaaagtcgtagaaagcattatttccctgatgtcaccaatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggaggttgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggagtcaatgattgtacacatgtgatgaagagattggtacatttgctggtaaagattcgtgtgcgtccttactacatgtatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4592 - protein, 416 aa, Artificial Sequence
  Description of Artificial Sequence: Synthetic Construct
MAESRRKHYFPDVTNEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEVVRIGSRAPVVLPQRITPQLVDMLKKYHPVWLNTHFNHPNEVTEEAVEACERMANAGIPLGNQTVLLRGVNDCTHVMKRLVHLLVKIRVRPYYMYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4593 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgagtggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaaaaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggctcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4594 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRVAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACEKMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVALRNYEGVITTYTEPEDYHEECDCEDCRVDKHREGVAALSGGQQLALEPPDLARKERRSDKN

SEQ ID NO: 4595 - DNA, 1251 bp, Artificial Sequence
  Description of Artificial Sequence: Synthetic Construct
atggcagaaagtcgtagaaagcattatttccctgatgtcaccaatgagcaatggtacgactggcattggcaggtcatcaatcgaattaagacgctcgaccagctggagaagtacgttacactcaccgctgaagaagaagagggagtaaaagaatcgcccaaagtactccgagtggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtacacgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggaggttgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggagtcaatgattgtacacatgtgatgaagagattggtacatttgctggtaaagattcgtgtgcgtccttactacatgtatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4596 - protein, 416 aa, Artificial Sequence
  Description of Artificial Sequence: Synthetic Construct
MAESRRKHYFPDVTNEQWYDWHWQVINRIKTLDQLEKYVTLTAEEEEGVKESPKVLRVAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEVVRIGSRAPVVLPQRITPQLVDMLKKYHPVWLNTHFNHPNEVTEEAVEACERMANAGIPLGNQTVLLRGVNDCTHVMKRLVHLLVKIRVRPYYMYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4597 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgcccgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggaggttgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaaaaatggccaatgccggtattccgttgggtaaccaaacggttttattgcgtggaatcaatgattgtacacatgtgatgaagagattggtacatttgctggtaaagattcgtgtgcgtccttactacatgtatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4598 - protein, 416 aa, Artificial Sequence
  Description of Artificial Sequence: Synthetic Construct
MAESRRKHYFPDVTDEQWYDWHWQVINRIKTPDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEVVRIGSRAPVVLPQRITPQLVDMLKKYHPVWLNTHFNHPNEVTEEAVEACEKMANAGIPLGNQTVLLRGINDCTHVMKRLVHLLVKIRVRPYYMYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4599 - DNA, 1251 bp, Artificial Sequence
  Description of Artificial Sequence: Synthetic Construct
atggcagaaagtcgtagaaagcattatttccctgatgtcaccaatgagcaatggtacgactggcattggcaggtcatcaatcgaattaagacgctcgaccagctggagaagtacgttacactcaccgctgaagaagaagagggagtaaaagaatcgcccaaagtactccgagtggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgccattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatgtatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4600 - protein, 416 aa, Artificial Sequence
  Description of Artificial Sequence: Synthetic Construct
MAESRRKHYFPDVTNEQWYDWHWQVINRIKTLDQLEKYVTLTAEEEEGVKESPKVLRVAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYMYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4601 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgagttaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggagtcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcggcaagcatcgtgagggcgtggctgcactttccggaggtcagcagttggctttagagcctcccgacttagctcgcaaagaacgcaggagcgataagaactaa

SEQ ID NO: 4602 - protein, 416 aa, Artificial Sequence
  Description of Artificial Sequence: Synthetic Construct
MAESRRKHYFPDVTDEQWYDWHWQVINRVKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGVNDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVGKHREGVAALSGGQQLALEPPDLARKERRSDKN

SEQ ID NO: 4603 - DNA, 1251 bp, Artificial Sequence
  Description of Artificial Sequence: Synthetic Construct
atggcagaaagtcgtagaaagcattatttccctgatgtcaccaatgagcaatggtacgactggcattggcaggtcatcaatcgaattaagacgctcgaccagctggagaagtacgttacacttaccgctgaagaagaagagggagtaaaagaatcgcccaaagtactccgaatggccatcacgccttattatttgagtttgatagaccccgagaatcctagttgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggaggttgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaaaaatggccaatgccggtattccgttgggtaaccaaacggttttattgcgtggagtcaatgattgtacacatgtgatgaagagattggtacatttgctggtaaagattcgtgtgcgtccttactacatgtatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4604 - protein, 416 aa, Artificial Sequence
  Description of Artificial Sequence: Synthetic Construct
MAESRRKHYFPDVTNEQWYDWHWQVINRIKTLDQLEKYVTLTAEEEEGVKESPKVLRMAITPYYLSLIDPENPSCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEVVRIGSRAPVVLPQRITPQLVDMLKKYHPVWLNTHFNHPNEVTEEAVEACEKMANAGIPLGNQTVLLRGVNDCTHVMKRLVHLLVKIRVRPYYMYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4605 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgagttaagacgctcgaccagctggagaagtacgttacactcaccgctgaagaagaagagggagtaaaagaatcgcccaaagtactccgagtggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggagtcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4606 - protein, 416 aa, Artificial Sequence
  Description of Artificial Sequence: Synthetic Construct
MAESRRKHYFPDVTDEQWYDWHWQVINRVKTLDQLEKYVTLTAEEEEGVKESPKVLRVAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGVNDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4607 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgagtggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatagatcgatgcattgagtatatagccaatacaccgacagtccgcgatgttttgctatcgggaggcgatgccctccttgtcagcgacgaacgcttggaatacatactgaagcgtctgcgcgaagtacctcatgtggaggttgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaaaaatggccaatgccggtattccgttgggtaaccaaacggttttattgcgtggagtcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4608 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRVAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEVVRIGSRAPVVLPQRITPQLVDMLKKYHPVWLNTHFNHPNEVTEEAVEACEKMANAGIPLGNQTVLLRGVNDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4609 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgagtggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggaggttgttcgtataggaagccgtgcgccggtagtcctccctcagcgtataacgcctcaattggtggatatgctcaaaagatatcatccggtgtggctgaacactcacttcaaccacccgaatgaagttaccgaagaagcagtggaggcttgtgaaaaaatggccaatgccggtattccgttgggtaaccaaacggttttattgcgtggaatcaatgattgtacacatgtgatgaagagattggtacatttgctggtaaagattcgtgtgcgtccttactacatgtatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4610 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRVAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEVVRIGSRAPVVLPQRITPQLVDMLKRYHPVWLNTHFNHPNEVTEEAVEACEKMANAGIPLGNQTVLLRGINDCTHVMKRLVHLLVKIRVRPYYMYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4611 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaaaaatggccaatgccggtattccgttgggtaaccaaacggttttattgcgtggagtcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggctcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4612 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACEKMANAGIPLGNQTVLLRGVNDCTHVMKRLVHLLVKIRVRPYYIYACDLSLGIGHFRTPVSKGIEIIENLRGHTSGYAVPTFVVHAPGGGGKIPVAPNYVVSQSPRHVALRNYEGVITTYTEPEDYHEECDCEDCRVDKHREGVAALSGGQQLALEPPDLARKERRSDKN

SEQ ID NO: 4613 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgagttaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggaggttgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaaaaatggccaatgccggtattccgttgggtaaccaaacggttttattgcgtggagtcaatgattgtacacatgtgatgaagagattggtacatttgctggtaaagattcgtgtgcgtccttactacatgtatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcgtgaggagtgcgattgtgaggactgccgagtcgacaagcatcgtgagggcgtggctgcactttccggaggtcagcagttggctttagagcctcccgactttgctcgcaaagaacgcaggagcgataagaactaa

SEQ ID NO: 4614 - protein, 416 aa, Artificial Sequence
  Description of Artificial Sequence: Synthetic Construct
MAESRRKHYFPDVTDEQWYDWHWQVINRVKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEVVRIGSRAPVVLPQRITPQLVDMLKKYHPVWLNTHFNHPNEVTEEAVEACEKMANAGIPLGNQTVLLRGVNDCTHVMKRLVHLLVKIRVRPYYMYACDLSLGIGHFRTPVSKGIEIIENLRGHTSGYAVPTFVVHAPGGGGKIPVAPNYVVSQSPRHVVLRNYEGVITTYTEPEDYREECDCEDCRVDKHREGVAALSGGQQLALEPPDFARKERRSDKN

SEQ ID NO: 4615 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaaaaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4616 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACEKMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4617 - DNA, 1251 bp, Artificial Sequence
  Description of Artificial Sequence: Synthetic Construct
atggcagaaagtcgtagaaagcattatttccctgatgtcaccaatgagcaatggtacgactggcattggcaggtcatcaatcgagttaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggagtcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactacgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4618 - protein, 416 aa, Artificial Sequence
  Description of Artificial Sequence: Synthetic Construct
MAESRRKHYFPDVTNEQWYDWHWQVINRVKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGVNDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4619 - DNA, 1251 bp, Artificial Sequence
  Description of Artificial Sequence: Synthetic Construct
atggcagaaagtcgtagaaagcattatttccctgatgtcaccaatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggaggttgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaaaaatggccaatgccggtattccgttgggtaaccaaacggttttattgcgtggagtcaatgattgtacacatgtgatgaagagattggtacatttgctggtaaagattcgtgtgcgtccttactacatgtatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4620 - protein, 416 aa, Artificial Sequence
  Description of Artificial Sequence: Synthetic Construct
MAESRRKHYFPDVTNEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEVVRIGSRAPVVLPQRITPQLVDMLKKYHPVWLNTHFNHPNEVTEEAVEACEKMANAGIPLGNQTVLLRGVNDCTHVMKRLVHLLVKIRVRPYYMYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4621 - DNA, 1251 bp, Artificial Sequence
  Description of Artificial Sequence: Synthetic Construct
atggcagaaagtcgtagaaagcattatttccctgatgtcaccaatgagcaatggtacgactggcattggcaggtcatcaatcgagttaagacgctcgaccagctggagaagtacgttacactcaccgctgaagaagaagagggagtaaaagaatcgcccaaagtactccgagtggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttccccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggaggttgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggagtcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggctcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4622 - protein, 416 aa, Artificial Sequence
  Description of Artificial Sequence: Synthetic Construct
MAESRRKHYFPDVTNEQWYDWHWQVINRVKTLDQLEKYVTLTAEEEEGVKESPKVLRVAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEVVRIGSRAPVVLPQRITPQLVDMLKKYHPVWLNTHFNHPNEVTEEAVEACERMANAGIPLGNQTVLLRGVNDCTHVMKRLVHLLVKIRVRPYYIYACDLSLGIGHFRTPVSKGIEIIENLRGHTSGYAVPTFVVHAPGGGGKIPVAPNYVVSQSPRHVALRNYEGVITTYTEPEDYHEECDCEDCRVDKHREGVAALSGGQQLALEPPDLARKERRSDKN

SEQ ID NO: 4623 - DNA, 1251 bp, Artificial Sequence
  Description of Artificial Sequence: Synthetic Construct
atggcagaaagtcgtagaaagcattatttccctgatgtcaccaatgagcaatggtacgactggcattggcaggtcatcaatcgaattaagacgctcgaccagctggagaagtacgttacactcaccgctgaagaagaagagggagtaaaagaatcgcccaaagtactccgagtggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtgactcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4624 - protein, 416 aa, Artificial Sequence
  Description of Artificial Sequence: Synthetic Construct
MAESRRKHYFPDVTNEQWYDWHWQVINRIKTLDQLEKYVTLTAEEEEGVKESPKVLRVAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVTLRNYEGVITTYTEPEDYHEECDCEDCRVDKHREGVAALSGGQQLALEPPDLARKERRSDKN

SEQ ID NO: 4625 - DNA, 1251 bp, Artificial Sequence
  Description of Artificial Sequence: Synthetic Construct
atggcagaaagtcgtagaaagcattatttccctgatgtcaccaatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggaggttgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatgtatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4626 - protein, 416 aa, Artificial Sequence
  Description of Artificial Sequence: Synthetic Construct
MAESRRKHYFPDVTNEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEVVRIGSRAPVVLPQRITPQLVDMLKKYHPVWLNTHFNHPNEVTEEAVEACERMANAGIPLGNQTVLLRGINDCTHVMKRLVHLLVKIRVRPYYMYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4627 - DNA, 1251 bp, Artificial Sequence
  Description of Artificial Sequence: Synthetic Construct
atggcagaaagtcgtagaaagcattatttccctgatgtcaccaatgagcaatggtacgactggcattggcaggtcatcaatcgagttaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggaggttgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggagtcaatgattgtacacatgtgatgaagagattggtacatttgctggtaaagattcgtgtgcgtccttactacatgtatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4628 - protein, 416 aa, Artificial Sequence
  Description of Artificial Sequence: Synthetic Construct
MAESRRKHYFPDVTNEQWYDWHWQVINRVKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEVVRIGSRAPVVLPQRITPQLVDMLKKYHPVWLNTHFNHPNEVTEEAVEACERMANAGIPLGNQTVLLRGVNDCTHVMKRLVHLLVKIRVRPYYMYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4629 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgagtggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggaggttgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatgtatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4630 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRVAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEVVRIGSRAPVVLPQRITPQLVDMLKKYHPVWLNTHFNHPNEVTEEAVEACERMANAGIPLGNQTVLLRGINDCTHVMKRLVHLLVKIRVRPYYMYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4631 - DNA, 1251 bp, Artificial Sequence
  Description of Artificial Sequence: Synthetic Construct
atgacagaaagtcgtagaaagcattatttccctgatgtcaccaatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggaggttgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatgtatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggctcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4632 - protein, 416 aa, Artificial Sequence
  Description of Artificial Sequence: Synthetic Construct
MTESRRKHYFPDVTNEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEVVRIGSRAPVVLPQRITPQLVDMLKKYHPVWLNTHFNHPNEVTEEAVEACERMANAGIPLGNQTVLLRGINDCTHVMKRLVHLLVKIRVRPYYMYACDLSLGIGHFRTPVSKGIEIIENLRGHTSGYAVPTFVVHAPGGGGKIPVAPNYVVSQSPRHVALRNYEGVITTYTEPEDYHEECDCEDCRVDKHREGVAALSGGQQLALEPPDLARKERRSDKN

SEQ ID NO: 4633 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggaggttgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4634 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEVVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4635 - DNA, 1251 bp, Artificial Sequence
  Description of Artificial Sequence: Synthetic Construct
atgacagaaagtcgtagaaagcattatttccctgatgtcaccgatgagcaatggtacgactggcattggcaggtcatcaatcgagttaagtcgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggagtcaatgattgtacacatgtgatgaagagattggtacatttgctggtaaagattcgtgtgcgtccttactacatgtatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4636 - protein, 416 aa, Artificial Sequence
  Description of Artificial Sequence: Synthetic Construct
MTESRRKHYFPDVTDEQWYDWHWQVINRVKSLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGVNDCTHVMKRLVHLLVKIRVRPYYMYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4637 - DNA, 1251 bp, Artificial Sequence
  Description of Artificial Sequence: Synthetic Construct
atggcagaaagtcgtagaaagcattatttccctgatgtcaccaatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggaggttgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggagtcaatgattgtacacatgtgatgaagagattggtacatttgctggtaaagattcgtgtgcgtccttactacatgtatacttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4638 - protein, 416 aa, Artificial Sequence
  Description of Artificial Sequence: Synthetic Construct
MAESRRKHYFPDVTNEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEVVRIGSRAPVVLPQRITPQLVDMLKKYHPVWLNTHFNHPNEVTEEAVEACERMANAGIPLGNQTVLLRGVNDCTHVMKRLVHLLVKIRVRPYYMYTCDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4639 - DNA, 1251 bp, Artificial Sequence
  Description of Artificial Sequence: Synthetic Construct
atggcagaaagtcgtagaaagcattatttccctgatgtcaccaatgagcaatggtacgactggcattggcaggtcatcaatcgagttaagtcgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggaggttgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatgtatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4640 - protein, 416 aa, Artificial Sequence
  Description of Artificial Sequence: Synthetic Construct
MAESRRKHYFPDVTNEQWYDWHWQVINRVKSLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEVVRIGSRAPVVLPQRITPQLVDMLKKYHPVWLNTHFNHPNEVTEEAVEACERMANAGIPLGNQTVLLRGINDCTHVMKRLVHLLVKIRVRPYYMYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4641 - DNA, 1251 bp, Artificial Sequence
  Description of Artificial Sequence: Synthetic Construct
atggcagaaagtcgtagaaagcattatttccctgatgtcaccaatgagcaatggtacgactggcattggcaggtcatcaatcgaattaagacgctcgaccagctggagaagtacgttacactcaccgctgaagaagaagagggagtaaaagaatcgcccaaagtactccgagtggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggagtcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttatatctcagtccccacgacatgtggctcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4642 - protein, 416 aa, Artificial Sequence
  Description of Artificial Sequence: Synthetic Construct
MAESRRKHYFPDVTNEQWYDWHWQVINRIKTLDQLEKYVTLTAEEEEGVKESPKVLRVAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGVNDCTHVMKRLVHLLVKIRVRPYYIYACDLSLGIGHFRTPVSKGIEIIENLRGHTSGYAVPTFVVHAPGGGGKIPVAPNYVISQSPRHVALRNYEGVITTYTEPEDYHEECDCEDCRVDKHREGVAALSGGQQLALEPPDLARKERRSDKN

SEQ ID NO: 4643 - DNA, 1251 bp, Artificial Sequence
  Description of Artificial Sequence: Synthetic Construct
atggcagaaagtcgtagaaagcattatttccctgatgtcaccaatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggaggttgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaaaaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4644 - protein, 416 aa, Artificial Sequence
  Description of Artificial Sequence: Synthetic Construct
MAESRRKHYFPDVTNEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEVVRIGSRAPVVLPQRITPQLVDMLKKYHPVWLNTHFNHPNEVTEEAVEACEKMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4645 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgagttaagtcgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggaggttgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaaaaatggccaatgccggtattccgttgggtaaccaaacggttttattgcgtggaatcaatgattgtacacatgtgatgaagagattggtacatttgctggtaaagattcgtgtgcgtccttactacatgtatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4646 - protein, 416 aa, Artificial Sequence
  Description of Artificial Sequence: Synthetic Construct
MAESRRKHYFPDVTDEQWYDWHWQVINRVKSLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEVVRIGSRAPVVLPQRITPQLVDMLKKYHPVWLNTHFNHPNEVTEEAVEACEKMANAGIPLGNQTVLLRGINDCTHVMKRLVHLLVKIRVRPYYMYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4647 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattcgcacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaggcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcggtaagcatcgtgagggcgtggctgcactttccggaggtcagcagttggctttagagactcccgacttagctcgcaaagggcgcgacggtgacaagaactaa

SEQ ID NO: 4648 - protein, 416 aa, Artificial Sequence
  Description of Artificial Sequence: Synthetic Construct
MAESRRKHYFPDVTDEQWYDWHWQVINRIRTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILRRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVGKHREGVAALSGGQQLALETPDLARKGRDGDKN

SEQ ID NO: 4649 - DNA, 1251 bp, Artificial Sequence
  Description of Artificial Sequence: Synthetic Construct
atggcagaaagtcgtagaaagcattatttccctgatgtcaccgatgagcaatggcacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacccgtagcgccgaactatgttgtatctcagtccccacgacatgtggttcttcgcaattatgaaggtgttatcacaacctatacggagccggaggactatcatgaggagtgcgattgtgaggactgccgagtcggtaagcatcgtgagggcgtggctgcactttccggaggtcagcagttggctttagagcctcccgacttagctcgcaaagagcgccagggtgacaagaactaa

SEQ ID NO: 4650 - protein, 416 aa, Artificial Sequence
  Description of Artificial Sequence: Synthetic Construct
MAESRRKHYFPDVTDEQWHDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVGKHREGVAALSGGQQLALEPPDLARKERQGDKN

SEQ ID NO: 4651 - DNA, 1251 bp, Artificial Sequence
  Description of Artificial Sequence: Synthetic Construct
atggcagaaagtcgtagaaagcattatttccctgatgtcaccgatgagcaatggcacgactggcattggcaggtcatcaatcgaattcgcacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcggtaagcatcgtgagggcgtggctgcactttccggaggtcagcagttggctttagagcctcccgacttagctcgcaaagagtgcgacagtgacaagaactaa

SEQ ID NO: 4652 - protein, 416 aa, Artificial Sequence
  Description of Artificial Sequence: Synthetic Construct
MAESRRKHYFPDVTDEQWHDWHWQVINRIRTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVGKHREGVAALSGGQQLALEPPDLARKECDSDKN

SEQ ID NO: 4653 - DNA, 1251 bp, Artificial Sequence
  Description of Artificial Sequence: Synthetic Construct
atggcagaaagtcgtagaaagcattatttccctgatgtcaccgatgagcaatggcacgactggcattggcaggtcatcaatcgaattcgcacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcggtaagcatcgtgagggcgtggctgcactttccggaggtcagcagttggctttagagctccccgacttagctcgcaaagagcgccagagtgacaagaactaa

SEQ ID NO: 4654 - protein, 416 aa, Artificial Sequence
  Description of Artificial Sequence: Synthetic Construct
MAESRRKHYFPDVTDEQWHDWHWQVINRIRTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVGKHREGVAALSGGQQLALELPDLARKERQSDKN

SEQ ID NO: 4655 - DNA, 1251 bp, Artificial Sequence
  Description of Artificial Sequence: Synthetic Construct
atggcagaaagtcgtagaaagcattatttccctgatgtcaccgatgagcaatggcacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcggtaagcatcgtgagggcgtggctgcactttccggaggtcagcagttggctttagagggacccgacttagctcgcaaagggcgcagtggtataaagaactaa

SEQ ID NO: 4656 - protein, 416 aa, Artificial Sequence
  Description of Artificial Sequence: Synthetic Construct
MAESRRKHYFPDVTDEQWHDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVGKHREGVAALSGGQQLALEGPDLARKGRSGIKN

SEQ ID NO: 4657 - DNA, 1251 bp, Artificial Sequence
  Description of Artificial Sequence: Synthetic Construct
atggcagaaagtcgtagaaagcattatttccctgatgtcaccgatgagcaatggcacgactggcattggcaggtcatcaatcgaattaagacgctcgaccagctggagaagtacgttacactcaccgctgaagaggaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagctccccgacttagctcgcaaagggcgcgacggtataaagaactaa

SEQ ID NO: 4658 - protein, 416 aa, Artificial Sequence
  Description of Artificial Sequence: Synthetic Construct
MAESRRKHYFPDVTDEQWHDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALELPDLARKGRDGIKN

SEQ ID NO: 4659 - DNA, 1251 bp, Artificial Sequence
  Description of Artificial Sequence: Synthetic Construct
atggcagaaagtcgtagaaagcattatttccctgatgtcaccgatgagcaatggcacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcggtaagcatcgtgagggcgtggctgcactttccggaggtcagcagttggctttagagactcccgacttagctcgcaaagggcgccagggtgacaagaactaa

SEQ ID NO: 4660 - protein, 416 aa, Artificial Sequence
  Description of Artificial Sequence: Synthetic Construct
MAESRRKHYFPDVTDEQWHDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVGKHREGVAALSGGQQLALETPDLARKGRQGDKN

SEQ ID NO: 4661 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaaggcgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttacccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagctccccgacttagctcgcaaagagcgccagagtataaagaactaa

SEQ ID NO: 4662 - protein, 416 aa, Artificial Sequence
  Description of Artificial Sequence: Synthetic Construct
MAESRRKHYFPDVTDEQWYDWHWQVINRIKALDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALELPDLARKERQSIKN

SEQ ID NO: 4663 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattcgcacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4664 - protein, 416 aa, Artificial Sequence
  Description of Artificial Sequence: Synthetic Construct
MAESRRKHYFPDVTDEQWYDWHWQVINRIRTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4665 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgacccatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtgtatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcggtaagcatcgtgagggcgtggctgcactttccggaggtcagcagttggctttagagcctcccgacttagctcgcaaagaacgcaggagcgataagaactaa

SEQ ID NO: 4666 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIECIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVGKHREGVAALSGGQQLALEPPDLARKERRSDKN

SEQ ID NO: 4667 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaggattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatcccagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4668 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVRIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4669 - DNA, 1251 bp, Artificial Sequence
  Description of Artificial Sequence: Synthetic Construct
atggcagaaagtcgtagaaagcattatttccctgatgtcaccgatgagcaatggcacgactggcattggcaggtcatcaatcgaattcgcacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaactggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcggtaagcatcgtgagggcgtggctactctttccggaggtcagcagttggctttagagcctcccgacttagctcgcaaagagcgccgtagtataaagaactaa

SEQ ID NO: 4670 - protein, 416 aa, Artificial Sequence
  Description of Artificial Sequence: Synthetic Construct
MAESRRKHYFPDVTDEQWHDWHWQVINRIRTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVGKHREGVATLSGGQQLALEPPDLARKERRSIKN

SEQ ID NO: 4671 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4672 - protein, 416 aa, Artificial Sequence; identical to SEQ ID NO: 3260
  Description of Artificial Sequence: Synthetic Construct

SEQ ID NO: 4673 - DNA, 1251 bp, Artificial Sequence
  Description of Artificial Sequence: Synthetic Construct
atggcagaaagtcgtagaaagcattatttccctgatgtcaccgatgagcaatggcacgactggcattggcaggtcatcaatcgaattcgcacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcggtaagcatcgtgagggcgtggctgcactttccggaggtcagcagttggctttagagctccccgacttagctcgcaaagggcgccgtagtgacaagaactaa

SEQ ID NO: 4674 - protein, 416 aa, Artificial Sequence
  Description of Artificial Sequence: Synthetic Construct
MAESRRKHYFPDVTDEQWHDWHWQVINRIRTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVGKHREGVAALSGGQQLALELPDLARKGRRSDKN

SEQ ID NO: 4675 - DNA, 1251 bp, Artificial Sequence
  Description of Artificial Sequence: Synthetic Construct
atggcagaaagtcgtagaaagcattatttccctgatgtcaccgatgagcaatggcacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcggtaagcatcgtgagggcgtggctgcactttccggaggtcagcagttggctttagagctccccgacttagctcgcaaagggcgccgtagtgacaagaactaa

SEQ ID NO: 4676 - protein, 416 aa, Artificial Sequence
  Description of Artificial Sequence: Synthetic Construct
MAESRRKHYFPDVTDEQWHDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVGKHREGVAALSGGQQLALELPDLARKGRRSDKN

SEQ ID NO: 4677 - DNA, 1251 bp, Artificial Sequence
  Description of Artificial Sequence: Synthetic Construct
atggcagaaagtcgtagaaagcattttttccctgatgtcaccgatgagcaatggcacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcggtaagcatcgtgagggcgtggctgcactttccggaggtcagcagttggctttagagggacccgacttagctcgcaaagggcgccagggtgacaagaactaa

SEQ ID NO: 4678 - protein, 416 aa, Artificial Sequence
  Description of Artificial Sequence: Synthetic Construct
MAESRRKHFFPDVTDEQWHDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVGKHREGVAALSGGQQLALEGPDLARKGRQGDKN

SEQ ID NO: 4679 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaggaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacacaggagcgataagaactaa

SEQ ID NO: 4680 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKEHRSDKN

SEQ ID NO: 4681 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgctatcacaacctatacggagccggaggactatcatgaggagtgcgattgtgaggactgccgagtcgacaagcatcgtgagggcgtggctgcactttccggaggtcagcagttggctttagagcctcccgacttagctcgtaaagaacgcaggagcgataagaactaa

SEQ ID NO: 4682 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGAITTYTEPEDYHEECDCEDCRVDKHREGVAALSGGQQLALEPPDLARKERRSDKN

SEQ ID NO: 4683 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaagtttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaagagtgcgattgtgaggactgccgagtcggtaagcatcgtgagggcgtggctgcactttccggaggtcagcagttggctttagagcctcccgacttagctcgcaaagagcgccgtggtgacaagaactaa

SEQ ID NO: 4684 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIESLRGHTSGYAVPTFVVHAPGGGGKIPVAPNYVVSQSPRHVVLRNYEGVITTYTEPEDYHEECDCEDCRVGKHREGVAALSGGQQLALEPPDLARKERRGDKN

SEQ ID NO: 4685 - DNA, 1251 bp, Artificial Sequence
  Description of Artificial Sequence: Synthetic Construct
atggcagaaagtcgtagaaagcattatttccctgatgtcaccgatgagcaatggcacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgaccgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtatagggagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaaacgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagagcgccagggtgacaagaactaa

SEQ ID NO: 4686 - protein, 416 aa, Artificial Sequence
  Description of Artificial Sequence: Synthetic Construct
MAESRRKHYFPDVTDEQWHDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGNEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERQGDKN

SEQ ID NO: 4687 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagctccccgacttagctcgcaaagagtgccggggtataaagaactaa

SEQ ID NO: 4688 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALELPDLARKECRGIKN

SEQ ID NO: 4689 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcatttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagctccccgacttagctcgcaaagggtgcgacagtgacaagaactaa

SEQ ID NO: 4690 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALELPDLARKGCDSDKN

SEQ ID NO: 4691 - DNA, 1251 bp, Artificial Sequence
  Description of Artificial Sequence: Synthetic Construct
atggcagaaagtcgtagaaagcattatttccctgatgtcaccgatgagcaatggcacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctactctttccggaggtcagcagttggctttagagcctcccgacttagctcgcaaagaacgcaggagcgataagaactaa

SEQ ID NO: 4692 - protein, 416 aa, Artificial Sequence
  Description of Artificial Sequence: Synthetic Construct
MAESRRKHYFPDVTDEQWHDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVATLSGGQQLALEPPDLARKERRSDKN

SEQ ID NO: 4693 - DNA, 1251 bp, Artificial Sequence
  Description of Artificial Sequence: Synthetic Construct
atggcagaaagtcgtagaaagcattatttccctgatgtcaccgatgagcaatggcacgactggcattggcaggtcatcaatcgaattcgcacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgctccttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcggtaagcatcgtgagggcgtggctgcactttccggaggtcagcagttggctttagagcctcccgacttagctcgcaaagaacgcaggagcgataagaactaa

SEQ ID NO: 4694 - protein, 416 aa, Artificial Sequence
  Description of Artificial Sequence: Synthetic Construct
MAESRRKHYFPDVTDEQWHDWHWQVINRIRTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDAPSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVGKHREGVAALSGGQQLALEPPDLARKERRSDKN

SEQ ID NO: 4695 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgactgtgaggactgccgagtcggtaagcatcgtgagggcgtggctactctttccggaggtcagcagttggctttagagcctcccgacttagctcgcaaagaacgcaggagcgataagaactaa

SEQ ID NO: 4696 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVGKHREGVATLSGGQQLALEPPDLARKERRSDKN

SEQ ID NO: 4697 - DNA, 1251 bp, Artificial Sequence
  Description of Artificial Sequence: Synthetic Construct
atggcagaaagtcgtagaaagcattatttccctgatgtcaccgatgagcaatggcacgactggcattggcaggtcatcaatcgaattcgcacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcggtaagcatcgtgagggcgtggctgcactttccggaggtcagcagttggctttagagggacccgacttagctcgcaaagagcgcgacggtgacaagaactaa

SEQ ID NO: 4698 - protein, 416 aa, Artificial Sequence
  Description of Artificial Sequence: Synthetic Construct
MAESRRKHYFPDVTDEQWHDWHWQVINRIRTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVGKHREGVAALSGGQQLALEGPDLARKERDGDKN

SEQ ID NO: 4699 - DNA, 1251 bp, Artificial Sequence
  Description of Artificial Sequence: Synthetic Construct
atggcagaaagtcgtagaaagcattatttccctgatgtcaccgatgagcaatggcacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaatgcaggagtgttaagaactaa

SEQ ID NO: 4700 - protein, 416 aa, Artificial Sequence
  Description of Artificial Sequence: Synthetic Construct
MAESRRKHYFPDVTDEQWHDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKECRSVKN

SEQ ID NO: 4701 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattcgcacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtttgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcggtaagcatcgtgagggcgtggctgcactttccggaggtcagcagttggctttagagactcccgacttagctcgcaaagggtgcgacggtgacaagaactaa

SEQ ID NO: 4702 - protein, 416 aa, Artificial Sequence
  Description of Artificial Sequence: Synthetic Construct
MAESRRKHYFPDVTDEQWYDWHWQVINRIRTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVGKHREGVAALSGGQQLALETPDLARKGCDGDKN

SEQ ID NO: 4703 - DNA, 1251 bp, Artificial Sequence
  Description of Artificial Sequence: Synthetic Construct
atggcagaaagtcgtagaaagcattatttccctgatgtcaccgatgagcaatggtacgactggcgttggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcggtaagcatcgtgagggcgtggctgcactttccggaggtcagcagttggctttagagcctcccgacttagctcgcaaagaacgcaggagcgataagaactaa

SEQ ID NO: 4704 - protein, 416 aa, Artificial Sequence
  Description of Artificial Sequence: Synthetic Construct
MAESRRKHYFPDVTDEQWYDWRWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVGKHREGVAALSGGQQLALEPPDLARKERRSDKN

SEQ ID NO: 4705 - DNA, 1251 bp, Artificial Sequence
  Description of Artificial Sequence: Synthetic Construct
atggcagaaagtcgtagaaagcattatttccctgatgtcaccgatgagcaatggcacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcggtaagcatcgtgagggcgtggctgcactttccggaggtcagcagttggctttagagcctcccgacttagctcgcaaagaacgcaggagcgataagaactaa

SEQ ID NO: 4706 - protein, 416 aa, Artificial Sequence
  Description of Artificial Sequence: Synthetic Construct
MAESRRKHYFPDVTDEQWHDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVGKHREGVAALSGGQQLALEPPDLARKERRSDKN

SEQ ID NO: 4707 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcaccaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtactcggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccgatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctactctttccggaggtcagcagttggctttagagcctcccgacttagctcgcaaagaacgccagagtgacaagaactaa

SEQ ID NO: 4708 - protein, 416 aa, Artificial Sequence
  Description of Artificial Sequence: Synthetic Construct
MAESRRKHYFPDVTDEQWYDWHWQVTNRIKTLDQLEKYVTLTAEEEEGVKESPKVLRMAITPYYLSLIDPENPNCPIRKQAIPTKRELVRAPEDMVDPLSEDEDSPVLGLTHRYPDRVLFLITDKCSMYCRHCTRRRFAGQRDASSPSERIDRCIEYIADTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVATLSGGQQLALEPPDLARKERQSDKN

SEQ ID NO: 4709 - DNA, 1251 bp, Artificial Sequence
  Description of Artificial Sequence: Synthetic Construct
atggcagaaagtcgtagaaagcattatttccctgatgtcaccgatgagcaatggcacgactggcattggcaggtcatcaatcgaattcgcacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagactcgcccgtacccggactgacccatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcggtaagcatcgtgagggcgtggctgcactttccggaggtcagcagttggctttagagctccccgacttagctcgcaaagaacgcaggagcgataagaactaa

SEQ ID NO: 4710 - protein, 416 aa, Artificial Sequence
  Description of Artificial Sequence: Synthetic Construct
MAESRRKHYFPDVTDEQWHDWHWQVINRIRTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVGKHREGVAALSGGQQLALELPDLARKERRSDKN

SEQ ID NO: 4711 - DNA, 1251 bp, Artificial Sequence
  Description of Artificial Sequence: Synthetic Construct
atggcagaaagtcgtagaaagcattatttccctgatgtcaccgatgagcaatggcacgactggcattggcaggtcatcaatcgaattcgcacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacgcctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4712 - protein, 416 aa, Artificial Sequence
  Description of Artificial Sequence: Synthetic Construct
MAESRRKHYFPDVTDEQWHDWHWQVINRIRTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHASGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4713 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccctactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcggtaagcatcgtgagggcgtggctactctttccggaggtcagcagttggctttagagcctcccgacttagctcgcaaagaacgcaggagcgataagaactaa

SEQ ID NO: 4714 - protein, 416 aa, Artificial Sequence; identical to SEQ ID NO: 4696
  Description of Artificial Sequence: Synthetic Construct

SEQ ID NO: 4715 - DNA, 1251 bp, Artificial Sequence
  Description of Artificial Sequence: Synthetic Construct
atggcagaaagtcgtagaaagcattatttccctgatgtcaccgataagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgcgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggtgatgccctccttgtcagcgacgaacgcttggaatacatactgaagcgtctgcgcgaagtacctcatgtggagattgttcgtataggaagccgtgcgccggtagtcctccctcagcgcataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctaccttcgtggtacatgctccggggggtggtggtaagatacctgtagcgccgaactatgtggtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctctagagcctcccgacttagctcgcaaagaacgcaggagcgataagaactaa

SEQ ID NO: 4716 - protein, 416 aa, Artificial Sequence; identical to SEQ ID NO: 4372
  Description of Artificial Sequence: Synthetic Construct

SEQ ID NO: 4717 - DNA, 1251 bp, Artificial Sequence
  Description of Artificial Sequence: Synthetic Construct
atggcagaaagtcgtagaaagcattacttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagttcgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagaaagatgcttcttctccttctgagcgcatcgatcgatgcattgagtatatagccaatacaccgacagtccgcgatgttttgctatcgggaggcgatgccctccttgtcagcgacgaacgcttggagtacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagcgattggtacatctgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgtcatgtggttcttcgcaattatgaaggtgttatcacaacctatacgcagccggaggactatcatgaggagtgcgattgtgaggactgccgtgtcgacaagcataaagagggcgtggctgcactttccggaggtcagcagttggctttagagcctcccgacttagctcgcaaagaacgcaggagcgataagaactaa

SEQ ID NO: 4718 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSSIDPENPNCPIRKQAIPTKRELVRAPEDMVDPLSEDEDSPVPGLTHRYPDRVLFLITDKCSMYCRHCTRRRFAGQKDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTQPEDYHEECDCEDCRVDKHKEGVAALSGGQQLALEPPDLARKERRSDKN

SEQ ID NO: 4719 - DNA, 1251 bp, Artificial Sequence
  Description of Artificial Sequence: Synthetic Construct
atggcagaaagtcgtagaaagcattacttccctgatgtcaccgatgagcaatggtacgactggcattggcaggtcatcaatcgaattaagacgctcgaccagctggagaagtacgttacactctccgctgaagaagaagagggagtaaaagaatcgcccaaagtactccgaatggctatcacgccttattatttgagtttgatagaccccgagaatcctaattgtccgattcgtaaacaagccattcctactaaacgggaactggtgcgtgctcctgaagatatggtagacccacttagtgaagatgaagattcgcccgtacccggactaactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacgcatgtgatgaagcgattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgtggtatctcagtccccgcgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4720 - protein, 416 aa, Artificial Sequence
  Description of Artificial Sequence: Synthetic Construct
MAESRRKHYFPDVTDEQWYDWHWQVINRIKTLDQLEKYVTLSAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4721 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtgtaggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatggcggtattccgttgggtaaccaaacggttttattgcgtggaatcaatgattgtacacatgtgatgaagagattggtacatttgctggtaaagattcgtgtgcgtccttactacgtatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4722 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRVGSRAPVVLPQRITPQLVDMLKKYHPVWLNTHFNHPNEVTEEAVEACERMANGGIPLGNQTVLLRGINDCTHVMKRLVHLLVKIRVRPYYVYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4723 - DNA, 1251 bp, Artificial Sequence
  Description of Artificial Sequence: Synthetic Construct
atggcagaaagtcgtagagagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtgtaggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatggcggtattccgttgggtaaccaaacggttttattgcgtggaatcaatgattgtacacatgtgatgaagagattggtacatttgctggtaaagattcgtgtgcgtccttactacgtatatgcttgcgatctttcgcttggaatagggcattaccgcacgccggtatctaagggagtcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccaacttagctcgcaaagaacgcaggagcgataagaactaa

SEQ ID NO: 4724 - protein, 416 aa, Artificial Sequence
  Description of Artificial Sequence: Synthetic Construct
MAESRREHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRVGSRAPVVLPQRITPQLVDMLKKYHPVWLNTHFNHPNEVTEEAVEACERMANGGIPLGNQTVLLRGINDCTHVMKRLVHLLVKIRVRPYYVYACDLSLGIGHYRTPVSKGVEIIENLRGHTSGYAVPTFVVHAPGGGGKIPVAPNYVVSQSPRHVVLRNYEGVITTYTEPEDYHEECDCEDCRVDKHREGVAALSGGQQLALEPPNLARKERRSDKN

SEQ ID NO: 4725 - DNA, 1251 bp, Artificial Sequence
  Description of Artificial Sequence: Synthetic Construct
atggcagaaagtcgtagagagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgccagcgacgaacgcttggaatacatactgaagcgtctgcgcgaagtacctcatgtggagattgttcgtgtaggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatggcggtattccgttgggtaaccaaacggttttattgcgtggaatcaatgattgtacacatgtgatgaagagattggtacatttgctggtaaagattcgtgtgcgtccttactacgtatatgcttgcgatctttcgcttggaatagggcattaccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataggaactaa

SEQ ID NO: 4726 - protein, 416 aa, Artificial Sequence
  Description of Artificial Sequence: Synthetic Construct
MAESRREHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLASDERLEYILKRLREVPHVEIVRVGSRAPVVLPQRITPQLVDMLKKYHPVWLNTHFNHPNEVTEEAVEACERMANGGIPLGNQTVLLRGINDCTHVMKRLVHLLVKIRVRPYYVYACDLSLGIGHYRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDRN

SEQ ID NO: 4727 - DNA, 1251 bp, Artificial Sequence
  Description of Artificial Sequence: Synthetic Construct
atggcagaaagtcgtagagagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtgtaggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacgtatatgcttgcgatctttcgcttggaatagggcattaccgcacgccggtatctaagggagtcgaaattatcgaaaatttgcgcggacacacctcgggctatgcagttcctacctttgtggtacatgctgcggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataggaactaa

SEQ ID NO: 4728 - protein, 416 aa, Artificial Sequence
  Description of Artificial Sequence: Synthetic Construct
MAESRREHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRVGSRAPVVLPQRITPQLVDMLKKYHPVWLNTHFNHPNEVTEEAVEACERMANAGIPLGNQTVLLRGINDCTHVMKRLVHLLVKIRVRPYYVYACDLSLGIGHYRTPVSKGVEIIENLRGHTSGYAVPTFVVHAAGGGGKIPVAPNYVVSQSPRHVVLRNYEGVITTYTEPEDYHEECDCEDCRVDKHREGVAALSGGQQLALEPPDLARKERRSDRN

SEQ ID NO: 4729 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgccagcgacgaacgcttggaatacatactgaagcgtctgcgcgaagtacctcgtgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatggcggtattccgttgggtaaccaaacggttttattgcgtggaatcaatgattgtacacatgtgatgaagagattggtacatttgctggtaaagattcgtgtgcgtccttactacgtatatgcttgcgatctttcgcttggaatagggcatttccgcacgccggtatctaagggagtcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4730 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLASDERLEYILKRLREVPRVEIVRIGSRAPVVLPQRITPQLVDMLKKYHPVWLNTHFNHPNEVTEEAVEACERMANGGIPLGNQTVLLRGINDCTHVMKRLVHLLVKIRVRPYYVYACDLSLGIGHFRTPVSKGVEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4731 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatggcggtattccgttgggtaaccaaacggttttattgcgtggaatcaatgattgtacacatgtgatgaagagattggtacatttgctggtaaagattcgtgtgcgtccttactacgtatatgcttgcgatctttcgcttggaatagggcatttccgcacgccggtatctaagggagtcgaaattatcgaaaatttgcgcggacacacctcgggctgtgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccaacttagctcgcaaagaacgcaggagcgataagaactaa

SEQ ID NO: 4732 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANGGIPLGNQTVLLRGINDCTHVMKRLVHLLVKIRVRPYYVYACDLSLGIGHFRTPVSKGVEIIENLRGHTSGCAVPTFVVHAPGGGGKIPVAPNYVVSQSPRHVVLRNYEGVITTYTEPEDYHEECDCEDCRVDKHREGVAALSGGQQLALEPPNLARKERRSDKN

SEQ ID NO: 4733 - DNA, 1251 bp, Artificial Sequence
  Description of Artificial Sequence: Synthetic Construct
atggcagaaagtcgtagagagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacgtatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccaacttagctcgcaaagaacgcaggagcgataagaactaa

SEQ ID NO: 4734 - protein, 416 aa, Artificial Sequence
  Description of Artificial Sequence: Synthetic Construct
MAESRREHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYVYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPNLARKERRSDKN

SEQ ID NO: 4735 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgagtggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagcacctcatgtggaggttgttcgtataggaagccgtgcgccggtagtcctccctcagcgtataacgcctcgattggtggatatgctcaaaaaatatcatccggtgtggctgaactctcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatgtatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacggcatgtggttcttcgcaattatgaaggtgttatcacaacctatacggagccggaggactatcatgaggagtgcgattgtgaggactgccgagtcgacaagcatcgtgagggcgtggctgcactttcctgaggtcagcagttggctttagagcctcccgacttagctcgcaaagaacgcaggagcgataagaactaa

SEQ ID NO: 4736 - protein, 394 aa, Artificial Sequence
  Description of Artificial Sequence: Synthetic Construct
MAESRRKHYFPDVTDEQWYDWHWQVINRIKTLDQLEKYVTLTAEEEEGVKESPKVLRVAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREAPHVEVVRIGSRAPVVLPQRITPRLVDMLKKYHPVWLNSHFNHPNEVTEEAVEACERMANAGIPLGNQTVLLRGINDCTHVMKRLVHLLVKIRVRPYYMYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALS

SEQ ID NO: 4737 - DNA, 1251 bp, Artificial Sequence
  Description of Artificial Sequence: Synthetic Construct
atggcagaaagtcgtagaaagcattatttccctgatgtcaccaatgagcaatggtacgactggcattggcaggtcatcaatcgagttaagtcgctcgaccagctggagaagtacgttacactcaccgctgaagaagaagagggagtaaaagaatcgcccaaagtactccgagtggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggaggttgttcgtataggaagccgtgcgccggtagtcctccctcagcgtataacgcctcaattggtggatatgctcaaaaaatatcatccggtgtggctgaactctcacttcaaccacccgaatgaagttaccgaagaagcagtggaggcttgtgaaagaatggccaatgccggtattccgttgggtaaccaaacggttttattgcgtggagtcaatgattgtacacatgtgatgaagagattggtacatttgctggtaaagattcgtgtgcgtccttactacatgtatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggctcttcgcaattatgaaggtgttatcacaacctatacggagccggaggactatcatgaggagtgggattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4738 - protein, 416 aa, Artificial Sequence
  Description of Artificial Sequence: Synthetic Construct
MAESRRKHYFPDVTNEQWYDWHWQVINRVKSLDQLEKYVTLTAEEEEGVKESPKVLRVAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEVVRIGSRAPVVLPQRITPQLVDMLKKYHPVWLNSHFNHPNEVTEEAVEACERMANAGIPLGNQTVLLRGVNDCTHVMKRLVHLLVKIRVRPYYMYACDLSLGIGHFRTPVSKGIEIIENLRGHTSGYAVPTFVVHAPGGGGKIPVAPNYVVSQSPRHVALRNYEGVITTYTEPEDYHEEWDCEDCRVDKHREGVAALSGGQQLALEPPDLARKERRSDKN

SEQ ID NO: 4739 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggaggttgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaaaaatggccaatgccggtattccgttgggtaaccaaacggttttattgcgtggaatcaatgattgtacacatgtgatgaagagattggtacatttgctggtaaagattcgtgtgcgtccttactacatgtatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggctcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4740 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEVVRIGSRAPVVLPQRITPQLVDMLKKYHPVWLNTHFNHPNEVTEEAVEACEKMANAGIPLGNQTVLLRGINDCTHVMKRLVHLLVKIRVRPYYMYACDLSLGIGHFRTPVSKGIEIIENLRGHTSGYAVPTFVVHAPGGGGKIPVAPNYVVSQSPRHVALRNYEGVITTYTEPEDYHEECDCEDCRVDKHREGVAALSGGQQLALEPPDLARKERRSDKN

SEQ ID NO: 4741 - DNA, 1251 bp, Artificial Sequence
  Description of Artificial Sequence: Synthetic Construct
atggcagaaagtcgtagaaagcattatttccctgatgtcaccaatgagcaatggtacgactggcattggcaggtcatcaatcgaattaagacgctcgaccagctggagaagtacgttacactcaccgctgaagaagaagagggagtaaaagaatcgcccaaagtactccgagtggctatcacgccttattattcgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctcctcgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaaaaatggccaatgccggtattccgttgggtaaccaaacggttttattgcgtggagtcaatgattgtacacatgtgatgaagagattggtacatttgctggtaaagattcgtgtgcgtccttactacatgtatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggctcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4742 - protein, 416 aa, Artificial Sequence
  Description of Artificial Sequence: Synthetic Construct
MAESRRKHYFPDVTNEQWYDWHWQVINRIKTLDQLEKYVTLTAEEEEGVKESPKVLRVAITPYYSSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACEKMANAGIPLGNQTVLLRGVNDCTHVMKRLVHLLVKIRVRPYYMYACDLSLGIGHFRTPVSKGIEIIENLRGHTSGYAVPTFVVHAPGGGGKIPVAPNYVVSQSPRHVALRNYEGVITTYTEPEDYHEECDCEDCRVDKHREGVAALSGGQQLALEPPDLARKERRSDKN

SEQ ID NO: 4743 - DNA, 1251 bp, Artificial Sequence
  Description of Artificial Sequence: Synthetic Construct
atggcagaaagtcgtagaaagcattatttccctgatgtcaccaatgagcaatggtacgactggcattggcaggtcatcaatcgaattaagacgctcgaccagctggagaagtacgttacactcaccgctgaagaagaagagggagtaaaagaatcgcccaaagtactccgagtggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggaggttgttcgtataggaagccgtgcgccggtagtcctccctcagcgtataacgcctcaattggtggatatgctcaaaaaatatcatccggtgtggctgaactctcacttcaaccacccgaatgaagttaccgaagaagcagtggaggcttgtgaaaaaatggccaatgccggtattccgttgggtaaccaaacggttttattgcgtggagtcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4744 - protein, 416 aa, Artificial Sequence
  Description of Artificial Sequence: Synthetic Construct
MAESRRKHYFPDVTNEQWYDWHWQVINRIKTLDQLEKYVTLTAEEEEGVKESPKVLRVAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEVVRIGSRAPVVLPQRITPQLVDMLKKYHPVWLNSHFNHPNEVTEEAVEACEKMANAGIPLGNQTVLLRGVNDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4745 - DNA, 1251 bp, Artificial Sequence
  Description of Artificial Sequence: Synthetic Construct
atggcagaaagtcgtagaaagcattatttccctggtgtcaccgatgagcaatggcacgactggcattggcaggtcatcaatcgaattcgcacgctcgaccagctggagaagtacgttacactcaccgctgaagaagaagagggagtaaaagaatcgcccaaagtactccgaatggctaacacgccttattatttgagtttgttagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcggtaagcatcgtgagggcgtggctgcactttccggaggtcagcagttggctttagagctccccgacttagctcgcaaagggtgccgtggtgacaagaactaa

SEQ ID NO: 4746 - protein, 416 aa, Artificial Sequence
  Description of Artificial Sequence: Synthetic Construct
MAESRRKHYFPGVTDEQWHDWHWQVINRIRTLDQLEKYVTLTAEEEEGVKESPKVLRMANTPYYLSLLDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVGKHREGVAALSGGQQLALELPDLARKGCRGDKN

SEQ ID NO: 4747 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgccgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctactctttccggaggtcagcagttggctttagagggacccgacttagctcgcaaagggcgccagggtgacaagaactaa

SEQ ID NO: 4748 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVATLSGGQQLALEGPDLARKGRQGDKN

SEQ ID NO: 4749 - DNA, 1251 bp, Artificial Sequence
  Description of Artificial Sequence: Synthetic Construct
atggcagaaagtcgtagaaagcattatttccctgatgtcaccgatgagcaatggcacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcggtaagcatcgtgagggcgtggctactctttccggaggtcagcagttggctttagagctccccgacttagctcgcaaagggcgcgacggtgacaagaactaa

SEQ ID NO: 4750 - protein, 416 aa, Artificial Sequence
  Description of Artificial Sequence: Synthetic Construct
MAESRRKHYFPDVTDEQWHDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVGKHREGVATLSGGQQLALELPDLARKGRDGDKN

SEQ ID NO: 4751 - DNA, 1251 bp, Artificial Sequence
  Description of Artificial Sequence: Synthetic Construct
atggcagaaagtcgtagaaggcattatttccctgatgtcaccgatgagcaatggcacgactggcattggcaggtcatcaatcgaattcgcacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgtcatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcggtaagcatcgtgagggcgtggctgcactttccggaggtcagcagttggctttagagactcccgacttagctcgcaaagagcgcagtggtgacaagaactaa

SEQ ID NO: 4752 - protein, 416 aa, Artificial Sequence
  Description of Artificial Sequence: Synthetic Construct
MAESRRRHYFPDVTDEQWHDWHWQVINRIRTLDQLEKYVTLTAEEEEGVKESPKVLRMAITPYYLSLIDPENPNCPIRKQAIPTKRELVRAPEDMVDPLSEDEDSPVPGLTHRHPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVGKHREGVAALSGGQQLALETPDLARKERSGDKN

SEQ ID NO: 4753 - DNA, 1251 bp, Artificial Sequence
  Description of Artificial Sequence: Synthetic Construct
atggcagaaagtcgtagaaagcattatttccctgatgtcaccgatgagcaatggcacgactggcattggcaggtcatcaatcgaattcgcacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggtattattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctactctttccggaggtcagcagttggctttagagctccccgacttagctcgcaaagagtgccagagtgacaagaactaa

SEQ ID NO: 4754 - protein, 416 aa, Artificial Sequence
  Description of Artificial Sequence: Synthetic Construct
MAESRRKHYFPDVTDEQWHDWHWQVINRIRTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVATLSGGQQLALELPDLARKECQSDKN

SEQ ID NO: 4755 - DNA, 1251 bp, Artificial Sequence
  Description of Artificial Sequence: Synthetic Construct
atggcagaaagtcgtagaaagcattatttccctgatgtcaccgatgagcaatggcacgactggcattggcaggtcatcaatcgaattcgcacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagtgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcggtaagcatcgtgagggcgtggctgcactttccggaggtcagcagttggctttagagactcccgacttagctcgcaaagaacgcaggagcgataagaactaa

SEQ ID NO: 4756 - protein, 416 aa, Artificial Sequence
  Description of Artificial Sequence: Synthetic Construct
MAESRRKHYFPDVTDEQWHDWHWQVINRIRTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQCITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVGKHREGVAALSGGQQLALETPDLARKERRSDKN

SEQ ID NO: 4757 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattcgcacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgctcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcggtaagcatcgtgagggcgtggctactctttccggaggtcagcagttggctttagagctccccgacttagctcgcaaagagtgcgacagtataaagaactaa

SEQ ID NO: 4758 - protein, 416 aa, Artificial Sequence
  Description of Artificial Sequence: Synthetic Construct
MAESRRKHYFPDVTDEQWYDWHWQVINRIRTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVGKHREGVATLSGGQQLALELPDLARKECDSIKN

SEQ ID NO: 4759 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatggaccccgagaatcctaattgtccggtgcgtaaacaagccgtgcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatgcggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4760 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLMDPENPNCPVRKQAVPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYAEPEDYHEECDCEDCRVDKHREGVAALSGGQQLALEPPDLARKERRSDKN

SEQ ID NO: 4761 - DNA, 1251 bp, Artificial Sequence
  Description of Artificial Sequence: Synthetic Construct
atggcagaaagtcgtagaaagcattatttccctgctgtcaccgatgagcaatggtacgactggcattggcaggtcatcaatcgaattaagacgctcgaccagctggagaagtacgttacactcaccgctgaagaagaagagggaatcaaagaatcgcccaaagtactccgaatggctatcacgccttattatttgagtttgatggaccccgagaatcctaattgtccggtgcgtaaacaagccgtgcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagatcgttcgtataggaagccgtgcgccggtagtcctccctcagcgtataacgccccaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4762 - protein, 416 aa, Artificial Sequence
  Description of Artificial Sequence: Synthetic Construct
MAESRRKHYFPAVTDEQWYDWHWQVINRIKTLDQLEKYVTLTAEEEEGIKESPKVLRMAITPYYLSLMDPENPNCPVRKQAVPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4763 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccgtgcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4764 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAVPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4765 - DNA, 1251 bp, Artificial Sequence
  Description of Artificial Sequence: Synthetic Construct
atggcagaaagtcgtagaaagcattattggcctgatgtcaccgatgagcaatggtacgactggcattggcaggtcatcaatcgaattaagacgctcgaccagctggagaagtacgttacactcaccgctgaagaagaagagggaatcaaagaatcgcccaaagtactccgaatggctatcacgccttattatttaagtttgatggaccccgagaatcctaattgtccgattcgtaaacaagccgtgcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctcccccagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgcgagggcgtggctgcactttccggaggtcagcagttggctttagagcctcccgacttagctcgcaaagaacgcaggagcgataagaactaa

SEQ ID NO: 4766 - protein, 416 aa, Artificial Sequence
  Description of Artificial Sequence: Synthetic Construct
MAESRRKHYWPDVTDEQWYDWHWQVINRIKTLDQLEKYVTLTAEEEEGIKESPKVLRMAITPYYLSLMDPENPNCPIRKQAVPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4767 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttaagtttgatggaccccgagaatcctaattgtccggtgcgtaaacaagccgtgcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4768 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLMDPENPNCPVRKQAVPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4769 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggaatcaaagaatcgcccaaagtactccgaatggctatcacgccttattatttaagtttgatggaccccgagaatcctaattgtccgattcgtaaacaagccgtgcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactga

SEQ ID NO: 4770 - protein, 416 aa, Artificial Sequence
  Description of Artificial Sequence: Synthetic Construct
MAESRRKHYFPDVTDEQWYDWHWQVINRIKTLDQLEKYVTLTAEEEEGIKESPKVLRMAITPYYLSLMDPENPNCPIRKQAVPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4771 - DNA, 1251 bp, Artificial Sequence
  Description of Artificial Sequence: Synthetic Construct
atggcagaaagtcgtagaaagcattattggcctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcgttgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggcatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4772 - protein, 416 aa, Artificial Sequence
  Description of Artificial Sequence: Synthetic Construct
MAESRRKHYWPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCVEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPASKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4773 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacggtggaccagttagagaagtacctgacaattaccgctgaagaagaagagggaatcaaagaatcgcccaaagtactccgaatggctatcacgccttattatttgagtttgatagaccccgagaatcctaattgtccggtgcgtaaacaagccattcctactaaacgggaactggtacatgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4774 - protein, 416 aa, Artificial Sequence
  Description of Artificial Sequence: Synthetic Construct
MAESRRKHYFPDVTDEQWYDWHWQVINRIKTVDQLEKYLTITAEEEEGIKESPKVLRMAITPYYLSLIDPENPNCPVRKQAIPTKRELVHAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4775 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttaagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4776 - protein, 416 aa, Artificial Sequence; identical to SEQ ID NO: 3260
  Description of Artificial Sequence: Synthetic Construct

SEQ ID NO: 4777 - DNA, 1251 bp, Artificial Sequence
  Description of Artificial Sequence: Synthetic Construct
atggcagaaagtcgtagaaagcattatttccctgctgtcaccgatgagcaatggtacgactggcattggcaggtcatcaatcgaattaagacgctcgaccagctggagaagtacgttacactcaccgctgaagaagaagagggaatcaaagaatcgcccaaagtactccgaatggctatcacgccttattatttaagtttgatggaccccgagaatcctaattgtccggtgcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaacacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtactcatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4778 - protein, 416 aa, Artificial Sequence
  Description of Artificial Sequence: Synthetic Construct
MAESRRKHYFPAVTDEQWYDWHWQVINRIKTLDQLEKYVTLTAEEEEGIKESPKVLRMAITPYYLSLMDPENPNCPVRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4779 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatgctagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4780 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYASLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4781 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccggtgcgtaaacaagccgtgcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4782 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPVRKQAVPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4783 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatgctagtttgatcgaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4784 - protein, 416 aa, Artificial Sequence; identical to SEQ ID NO: 4780
  Description of Artificial Sequence: Synthetic Construct

SEQ ID NO: 4785 - DNA, 1251 bp, Artificial Sequence
  Description of Artificial Sequence: Synthetic Construct
atggcagaaagtcgtagaaagcattatttccctgctgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttaagtttgatggaccccgagaatcctaattgtccggtgcgtaaacaagccgtgcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctgtcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4786 - protein, 416 aa, Artificial Sequence
  Description of Artificial Sequence: Synthetic Construct
MAESRRKHYFPAVTDEQWYDWHWQVINRIKTLDQLEKYVTLTAEEEEGVKESPKVLRMAITPYYLSLMDPENPNCPVRKQAVPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4787 - DNA, 1251 bp, Artificial Sequence
  Description of Artificial Sequence: Synthetic Construct
atggcagaaagtcgtagaaagcattattggcctgatgtcaccgatgagcaatggtacgactggcattggcaggtcaccaatcgaattaagacgctcgaccagctggagaagtacgttacactcaccgctgaagaagaagagggagtaaaagaatcgcccaaagtactccgaatgactatcacgccttattatttaagtttgattgaccccgagaatcctaattgtccgattcgtaaacaagccgtgcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4788 - protein, 416 aa, Artificial Sequence
  Description of Artificial Sequence: Synthetic Construct
MAESRRKHYWPDVTDEQWYDWHWQVTNRIKTLDQLEKYVTLTAEEEEGVKESPKVLRMTITPYYLSLIDPENPNCPIRKQAVPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4789 - DNA, 1251 bp, Artificial Sequence
  Description of Artificial Sequence: Synthetic Construct
atggcagaaagtcgtagaaagcattattggcctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatggaccccgagaatcctaattgtccggtgcgtaaacaagccgtgcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4790 - protein, 416 aa, Artificial Sequence
  Description of Artificial Sequence: Synthetic Construct
MAESRRKHYWPDVTDEQWYDWHWQVINRIKTLDQLEKYVTLTAEEEEGVKESPKVLRMAITPYYLSLMDPENPNCPVRKQAVPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4791 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttaagtttgatggaccccgagaatcctaattgtccggtgcgtaaacaagccgtgcctactaaacgggaactggtacgtgctcctgaagatatggtagacccacttagtgaagatgatgattcgtccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4792 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLMDPENPNCPVRKQAVPTKRELVRAPEDMVDPLSEDDDSSVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4793 - DNA, 1251 bp, Artificial Sequence
  Description of Artificial Sequence: Synthetic Construct
atggcagaaagtcgtagaaagcattattggcctgatgtcaccgatgagcaatggtacgactggcattggcaggtcatcaatcgaattaagacggtggaccagttagagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4794 - protein, 416 aa, Artificial Sequence
  Description of Artificial Sequence: Synthetic Construct
MAESRRKHYWPDVTDEQWYDWHWQVINRIKTVDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4795 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccggtgcgtaaacaagccgtgcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacgccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4796 - protein, 416 aa, Artificial Sequence; identical to SEQ ID NO: 4782
  Description of Artificial Sequence: Synthetic Construct

SEQ ID NO: 4797 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttaagtttgatggaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4798 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLMDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4799 - DNA, 1251 bp, Artificial Sequence
  Description of Artificial Sequence: Synthetic Construct
atggcagaaagtcgtaaaaagcattatttccctgctgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccggtgcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtaccccatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatgcctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4800 - protein, 416 aa, Artificial Sequence
  Description of Artificial Sequence: Synthetic Construct
MAESRKKHYFPAVTDEQWYDWHWQVINRIKTLDQLEKYVTLTAEEEEGVKESPKVLRMAITPYYLSLIDPENPNCPVRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKMPVAPNYVVSQSPRHVVLRNYEGVITTYTEPEDYHEECDCEDCRVDKHREGVAALSGGQQLALEPPDLARKERRSDKN

SEQ ID NO: 4801 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggaatcaaagaatcgcccaaagtactccgaatggctatcacgccttattatgctagtttgatcgaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgcggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4802 - protein, 416 aa, Artificial Sequence
  Description of Artificial Sequence: Synthetic Construct
MAESRRKHYFPDVTDEQWYDWHWQVINRIKTLDQLEKYVTLTAEEEEGIKESPKVLRMAITPYYASLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHAVLRNYEGVITTYTEPEDYHEECDCEDCRVDKHREGVAALSGGQQLALEPPDLARKERRSDKN

SEQ ID NO: 4803 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacggtggaccagctggagaagtacgttacacttaccgctgaagaagaagagggaatcaaagaatcgcccaaagtactccgaatggctatcacgccttattatttgagtttgatggaccccgagaatcctaattgtccgattcgtaaacaagccgtgcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4804 - protein, 416 aa, Artificial Sequence
  Description of Artificial Sequence: Synthetic Construct
MAESRRKHYFPDVTDEQWYDWHWQVINRIKTVDQLEKYVTLTAEEEEGIKESPKVLRMAITPYYLSLMDPENPNCPIRKQAVPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4805 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttaagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacttcatgtggagattgttcgtatagggagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4806 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVLHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4807 - DNA, 1251 bp, Artificial Sequence
  Description of Artificial Sequence: Synthetic Construct
atggcagaaagtcgtagaaagcattattggcctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggggattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgtagggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgtcatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4808 - protein, 255 aa, Artificial Sequence
  Description of Artificial Sequence: Synthetic Construct
MAESRRKHYWPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVGIVRIGSRAPVVLPQRITPQLVDMLKKYHPVWLNTHFNHPNEVTEEAVEACERMANAGIP

SEQ ID NO: 4809 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaaggagagggagtaaaagaatcgcccaaagtactccgaatggctatcacgccttattatttgagtttgatagaccccgagaatcctaattgtccgattcgtaaacaagccgtgcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4810 - protein, 416 aa, Artificial Sequence
  Description of Artificial Sequence: Synthetic Construct
MAESRRKHYFPDVTDEQWYDWHWQVINRIKTLDQLEKYVTLTAEEGEGVKESPKVLRMAITPYYLSLIDPENPNCPIRKQAVPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4811 - DNA, 1251 bp, Artificial Sequence
  Description of Artificial Sequence: Synthetic Construct
atggcagaaagtcgtagaaagcattatttccccgctgtcaccgatgagcaatggtacgactggcattggcaggtcatcaatcgaattaagacgctcgaccagctggagaagtacgttacactcaccgctgaagaagaagagggaatccaagaatcgcccaaagtactccgaatggctatcacgccttattatttgagtttgatagaccccgagaatcctaattgtccgattcgtaaacaagccgtgcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4812 - protein, 416 aa, Artificial Sequence
  Description of Artificial Sequence: Synthetic Construct
MAESRRKHYFPAVTDEQWYDWHWQVINRIKTLDQLEKYVTLTAEEEEGIQESPKVLRMAITPYYLSLIDPENPNCPIRKQAVPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4813 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttaagtttgatcgaccccgagaatcctaattgtccgattcgtaaacaagccgtgcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4814 - protein, 416 aa, Artificial Sequence; identical to SEQ ID NO: 4764
  Description of Artificial Sequence: Synthetic Construct

SEQ ID NO: 4815 - DNA, 1251 bp, Artificial Sequence
  Description of Artificial Sequence: Synthetic Construct
atggcagaaagtcgtagaaagcattattggcccgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttaagtttgatggaccccgagaatcctaattgtccgattcgtaaacaagccattcctactaaacgggaactggtacgtgctcctgaagatatggtagacccacttagtgaagatgaggattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4816 - protein, 416 aa, Artificial Sequence
  Description of Artificial Sequence: Synthetic Construct
MAESRRKHYWPDVTDEQWYDWHWQVINRIKTLDQLEKYVTLTAEEEEGVKESPKVLRMAITPYYLSLMDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4817 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggaatcaaagaatcgcccaaagtactccgaatggctatcacgccttattatttgagtttgatagaccccgagaatcctaattgtccggtgcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatggaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4818 - protein, 416 aa, Artificial Sequence
  Description of Artificial Sequence: Synthetic Construct
MAESRRKHYFPDVTDEQWYDWHWQVINRIKTLDQLEKYVTLTAEEEEGIKESPKVLRMAITPYYLSLIDPENPNCPVRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYGGVITTYTEPEDYHEECDCEDCRVDKHREGVAALSGGQQLALEPPDLARKERRSDKN

SEQ ID NO: 4819 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttaagtttgatggaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4820 - protein, 416 aa, Artificial Sequence; identical to SEQ ID NO: 4798
  Description of Artificial Sequence: Synthetic Construct

SEQ ID NO: 4821 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttaagtttgatggaccccgagaatcctaattgtccgattcgtaaacaagccgtgcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacgagcatcgtgagggcgtggctgcactttccggaggtcagcagttggctttagagcctcccgacttagctcgcaaagaacgcaggagcgataagaactaa

SEQ ID NO: 4822 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLMDPENPNCPIRKQAVPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDEHREGVAALSGGQQLALEPPDLARKERRSDKN

SEQ ID NO: 4823 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttaagtttgatggaccccgagaatcctaattgtccgattcgtaaacaagccattcctactaaacgggaactggtacgtgctcctgaagacatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4824 - protein, 416 aa, Artificial Sequence; identical to SEQ ID NO: 4798
  Description of Artificial Sequence: Synthetic Construct

SEQ ID NO: 4825 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccggtgcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4826 - protein, 416 aa, Artificial Sequence; identical to SEQ ID NO: 3728
  Description of Artificial Sequence: Synthetic Construct

SEQ ID NO: 4827 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatgctagtttgatcgaccccgagaatcctaattgtccgattcgtaaacaagccgtgcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaacacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttgtcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4828 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYASLIDPENPNCPIRKQAVPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVVTTYTEPEDYHEECDCEDCRVDKHREGVAALSGGQQLALEPPDLARKERRSDKN

SEQ ID NO: 4829 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttaagtttgatcgaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgccgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4830 - protein, 416 aa, Artificial Sequence; identical to SEQ ID NO: 3260
  Description of Artificial Sequence: Synthetic Construct

SEQ ID NO: 4831 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacgtcaaccacccgaatgaagttaccgaagaagcagtggaggcttgtggaagaatggccaatgccggtattccgttgggtaaccaaacggttttattgcgtggaatcaatgattgtacacatgtgatgaagagattggtacatttgctggtaaagattcgtgtgcgtccttactacctgtatgcttgcgatctttcgcttggaatagggcatttccgcacgccggtatctaagggaatcgaaattatcgaaaatttgcgcggacacacctcgggcttcgcagttcctacctttgtggtccatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4832 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHVNHPNEVTEEAVEACGRMANAGIPLGNQTVLLRGINDCTHVMKRLVHLLVKIRVRPYYLYACDLSLGIGHFRTPVSKGIEIIENLRGHTSGFAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4833 - DNA, 1251 bp, Artificial Sequence
  Description of Artificial Sequence: Synthetic Construct
atggcagaaagtcgcagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagtcgtgcgccggtagtcctccctcagcgtataacgcctcaattggtggacatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggcttcgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4834 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGFAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4835 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccgatattccgttgggtaaccaaacggttttattgcgtggaatcaatgattgtacacatgtgatgaagagattggtacatttgctggtaaagattcgtgtgcgtccttactacctgtatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4836 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANADIPLGNQTVLLRGINDCTHVMKRLVHLLVKIRVRPYYLYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4837 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccggatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagtcgtgcgccggtagtcctccctcagcgtataacgcctcaatttgtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtgttcatgtgatgaagagattggtacatttgctggtaaagattcgtgtgcgtccttactacctgtatgcttgcgatctttcgcttggaatagggcatttccgcacgccggtatctaagggaatcgaaattatcgaaaatttgcgcggacacacctcgggcttcgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4838 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQFVDMLKKYHPVWLNTHFNHPNEVTEEAVEACERMANAGIPLGNQTVLLRGINDCVHVMKRLVHLLVKIRVRPYYLYACDLSLGIGHFRTPVSKGIEIIENLRGHTSGFAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4839 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctgaagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaaatcgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacctgtatgcttgcgatctttcgcttggaatagggcatttccgcacgccggtatctaagggaatcgaaattatcgaaaatttgcgcggacacacctcgggcttcgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4840 - protein, 416 aa, Artificial Sequence
  Description of Artificial Sequence: Synthetic Construct
MAESRRKHYFPDVTDEQWYDWHWQVINRIKTLDQLKKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGNRAPVVLPQRITPQLVDMLKKYHPVWLNTHFNHPNEVTEEAVEACERMANAGIPLGNQTVLLRGINDCTHVMKRLVHLLVKIRVRPYYLYACDLSLGIGHFRTPVSKGIEIIENLRGHTSGFAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4841 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacctgtatgcttgcgatctttcgcttggaatagggcatttccgcacgccggtatctaagggaatcgaaattatcgaaaatttgcgcggacacacctcgggctatgcagttcctacctatgtgatccatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgatgagaactaa

SEQ ID NO: 4842 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYLYACDLSLGIGHFRTPVSKGIEIIENLRGHTSGYAVPTYVIHAPGGGGKIPVAPNYVVSQSPRHVVLRNYEGVITTYTEPEDYHEECDCEDCRVDKHREGVAALSGGQQLALEPPDLARKERRSDEN

SEQ ID NO: 4843 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagtcgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacctgtatgcttgcgatctttcgcttggaatagggcatttccgcacgccggtatctaagggaatcgaaattatcgaaaatttgcgcggacacacctcgggcttcgcagttcctacctttgtggtccatgctccggggggtggtggtatgatacctctggcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4844 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYLYACDLSLGIGHFRTPVSKGIEIIENLRGHTSGFAVPTFVVHAPGGGGMIPLAPNYVVSQSPRHVVLRNYEGVITTYTEPEDYHEECDCEDCRVDKHREGVAALSGGQQLALEPPDLARKERRSDKN

SEQ ID NO: 4845 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagtcgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacctgtatgcttgcgatctttcgcttggaatagggcatttccgcacgccggtatctaagggaatcgaaattatcgaaaatttgcgcggacacacctcgggcttcgcagttcctacctttgtggtacatgctccggggggtggtggtaagatacctgtagcgccgaactatttagtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccgggggtcagcagttggctttagagcctcccgacttagctcgcaaagaacgcaggagcgataagaactaa

SEQ ID NO: 4846 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYLYACDLSLGIGHFRTPVSKGIEIIENLRGHTSGFAVPTFVVHAPGGGGKIPVAPNYLVSQSPRHVVLRNYEGVITTYTEPEDYHEECDCEDCRVDKHREGVAALSGGQQLALEPPDLARKERRSDKN

SEQ ID NO: 4847 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctggacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacctgtatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctctggcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttggagcctcccgacttagctcgcaaagaacgcaggagcgataagaactaa

SEQ ID NO: 4848 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLDTHFNHPNEVTEEAVEACERMANAGIPLGNQTVLLRGINDCTHVMKRLVHLLVKIRVRPYYLYACDLSLGIGHFRTPVSKGIEIIENLRGHTSGYAVPTFVVHAPGGGGKIPLAPNYVVSQSPRHVVLRNYEGVITTYTEPEDYHEECDCEDCRVDKHREGVAALSGGQQLALEPPDLARKERRSDKN

SEQ ID NO: 4849 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagtcgtacaccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacctgtatgcttgcgatctttcgcttggaatagggcatttccgcacgccggtatctaagggaatcgaaattatcgaaaatttgcgcggacacacctcgggcttcgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4850 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKIRVRPYYLYACDLSLGIGHFRTPVSKGIEIIENLRGHTSGFAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4851 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttacccggatcgtgtattgttccttatcacggacaaatgttcgatgtactgtcgtcattgcactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacctgtatgcttgcgatctttcgcttggaatagggcatttccgcacgccggtatctaagggaatcgaaattatcgaaaatttgcgcggacacacctcgggcttcgcagttcctacctttgtggtccatgctccggggggtggtggtaagatacctgtagcgccgaactatttagtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4852 - protein, 416 aa, Artificial Sequence; identical to SEQ ID NO: 4846
  Description of Artificial Sequence: Synthetic Construct

SEQ ID NO: 4853 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagtcgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtcctcatgtgatgaagagattggtacatttgctggtaaagattcgtgtgcgtccttactacctgtatgcttgcgatctttcgcttggaatagggcatttccgcacgccggtatctaagggaatcgaaattatcgaaaatttgcgcggacacacctcgggctatgcagttcctacctatgtggtccatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4854 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCPHVMKRLVHLLVKIRVRPYYLYACDLSLGIGHFRTPVSKGIEIIENLRGHTSGYAVPTYVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4855 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggcgatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagaaattggtacatctgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4856 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKKLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4857 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaaaaactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagcgcttggtacatctgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttatctctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4858 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKKLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVISQSPRHVVLRNYEGVITTYTEPEDYHEECDCEDCRVDKHREGVAALSGGQQLALEPPDLARKERRSDKN

SEQ ID NO: 4859 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttacccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagcgcttggtacatctgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctaccgttgtggtacatgctccggggggtggtggtaagatacctgtagcgccgaactatgttatctctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagaccgcaaagaacgcaggagcgataagaactaa

SEQ ID NO: 4860 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTVVVHAPGGGGKIPVAPNYVISQSPRHVVLRNYEGVITTYTEPEDYHEECDCEDCRVDKHREGVAALSGGQQLALEPPDLDRKERRSDKN

SEQ ID NO: 4861 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgcaaacgcttcgcgggacagagagatgcttcttctccttctgagcgcatcgttcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagaaattggtacataagctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttatctctcagtccccacgacatgtgattcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagaacgcaaagaacgcaggagcgataagaactaa

SEQ ID NO: 4862 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRKRFAGQRDASSPSERIVRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKKLVHKLVKIRVRPYYIYACDLSLGIGHFRTPVSKGIEIIENLRGHTSGYAVPTFVVHAPGGGGKIPVAPNYVISQSPRHVILRNYEGVITTYTEPEDYHEECDCEDCRVDKHREGVAALSGGQQLALEPPDLERKERRSDKN

SEQ ID NO: 4863 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgaactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagaaattggtacatctgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatgctgagggcgtcgctgcactttcaggaggtcagcagttggctttagagcctcccgacttagaacgcaaagaacgcaggagcgataagaactaa

SEQ ID NO: 4864 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMNCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKKLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHAEGVAALSGGQQLALEPPDLERKERRSDKN

SEQ ID NO: 4865 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaaaaactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgcaaacgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagaaattggtacataagctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttatctctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagaacgcaaagaacgcaggagcgataagaactaa

SEQ ID NO: 4866 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKKLRMAITPYYLSLIDPENPNCPIRKQAIPTKRELVRAPEDMVDPLSEDEDSPVPGLTHRYPDRVLFLITDKCSMYCRHCTRKRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKKLVHKLVKIRVRPYYIYACDLSLGIGHFRTPVSKGIEIIENLRGHTSGYAVPTFVVHAPGGGGKIPVAPNYVISQSPRHVVLRNYEGVITTYTEPEDYHEECDCEDCRVDKHREGVAALSGGQQLALEPPDLERKERRSDKN

SEQ ID NO: 4867 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaaaaactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagcgcttggtacatctgctggtaaagattcgtgtgcgtccttactacatatatgcttgcgatctttcgcttggaatagggcatttccgcacgccggtatctaagggaatcgaaatcatcgaaaatttgcgcggacacacctcgggctatgcagttcctacctttgtggtacatgctccggggggtggtggtaagatacctgcagcgccgaactatgttatctctcagtccccacgacatgtggttcttcgcaattatgaaggtgttatcacaacctatacggagccggaggactatcatgaggagtgcgattgtgaggactgccgagtcgacaagcatgctgagggcgtcgctgcacttttaggaggtcagcagttggctttagagcctcccgacttagaacgcaaagaacgcaggagcgataagaactaa

SEQ ID NO: 4868 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKKLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPAAPNYVISQSPRHVVLRNYEGVITTYTEPEDYHEECDCEDCRVDKHAEGVAALLGGQQLALEPPDLERKERRSDKN

SEQ ID NO: 4869 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgcaaacgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagcgcttggtacataagctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttctggaggtcagcagttggctttagagcctcccgacttagaacgcaaagaacgcaggagcgataagaactaa

SEQ ID NO: 4870 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRKRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHKLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLERKERRSDKN

SEQ ID NO: 4871 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagcgcttggtacatctgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtgattcttcgcaattatgaaggtgttatcacaacctatacggagccggaggactatcatgaggagtgcgattgtgaggactgccgagtcgacaagcatgctgagggcgtcgctgcactttcaggaggtcagcagttggctttagagcctcccgacttagaacgcaaagaacgcaggagcgataagaactaa

SEQ ID NO: 4872 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVILRNYEGVITTYTEPEDYHEECDCEDCRVDKHAEGVAALSGGQQLALEPPDLERKERRSDKN

SEQ ID NO: 4873 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgcaaacgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagcgcttggtacataagctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4874 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRKRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHKLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4875 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaaaaactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgcaaacgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagaaattggtacatctgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatgctgagggcgtcgctgcactttcaagaggtcagcagttggctttagagcctcccgacttagctcgcaaagaacgcaggagcgataagaactaa

SEQ ID NO: 4876 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKKLRMAITPYYLSLIDPENPNCPIRKQAIPTKRELVRAPEDMVDPLSEDEDSPVPGLTHRYPDRVLFLITDKCSMYCRHCTRKRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKKLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHAEGVAALSRGQQLALEPPDLARKERRSDKN

SEQ ID NO: 4877 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggataaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatggttgtacacatgtgatgaagcgcttggtacatctgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtcgctgcacttttaggaggtcagcagttggctttagagcctcccgacttagctcgcaaagaacgcaggagcgataagaactaa

SEQ ID NO: 4878 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINGCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALLGGQQLALEPPDLARKERRSDKN

SEQ ID NO: 4879 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgcaaacgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcccacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtcgctgcactttcaggaggtcagcagttggctttagagcctcccgacttagctcgcaaagaacgcaggagcgataagaactaa

SEQ ID NO: 4880 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRKRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4881 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaaaaactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacggagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacctgaatgaagttaccgaagaagcagtggaggcttgtgaaagaatggccaatgccggtattccgttgggtaaccaaacggttttattgcgtggaatcaatgattgtacacatgtgatgaagaaattggtacataagctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4882 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKKLRMAITPYYLSLIDPENPNCPIRKQAIPTKRELVRAPEDMVDPLSEDEDSPVPGLTHRYPDRVLFLITDKCSMYCRHCTRRRFAGRRDASSPSERIDRCIEYIANTPTVRDVLLSGGDALLVSDERLEYILKRLREVPHVEIVRIGSRAPVVLPQRITPQLVDMLKKYHPVWLNTHFNHLNEVTEEAVEACERMANAGIPLGNQTVLLRGINDCTHVMKKLVHKLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4883 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagaaattggtacatctgctggtaaagattcgtgtgcgtccttactacatatatgcttgcgatctttcgcttggaatagggcatttccgcacgccggtatctaagggaatcaaaattatcgaaaatttgcgcggacacacctcgggctatgcagttcctacctttgtggtacatgctccggggggtggtggtaagatacctgtagcgccgaactatgttatctctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagaacgcaaagaacgcaggagcgataagaactaa

SEQ ID NO: 4884 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKKLVHLLVKIRVRPYYIYACDLSLGIGHFRTPVSKGIKIIENLRGHTSGYAVPTFVVHAPGGGGKIPVAPNYVISQSPRHVVLRNYEGVITTYTEPEDYHEECDCEDCRVDKHREGVAALSGGQQLALEPPDLERKERRSDKN

SEQ ID NO: 4885 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcggtgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagcgcttggtacatctgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttatctctcagtccccacgacatgtggttcttcgcaattatgaaggtgttatcacaacctatacggagccggaggactatcatgaggagtgcgattgtgaggactgccgagtcgacaagcatcgtgagggcatcgctgcactttcaggaggtcagcagttggctttagagcctcccgacttagctcgcaaagaacgcaggagcgataagaactaa

SEQ ID NO: 4886 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSVYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVISQSPRHVVLRNYEGVITTYTEPEDYHEECDCEDCRVDKHREGIAALSGGQQLALEPPDLARKERRSDKN

SEQ ID NO: 4887 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagcgcttggtacataagctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4888 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHKLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4889 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgcaaacgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagaaattggtacataagctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttatctctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcagagaacgcaggagcgataagaactaa

SEQ ID NO: 4890 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRKRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKKLVHKLVKIRVRPYYIYACDLSLGIGHFRTPVSKGIEIIENLRGHTSGYAVPTFVVHAPGGGGKIPVAPNYVISQSPRHVVLRNYEGVITTYTEPEDYHEECDCEDCRVDKHREGVAALSGGQQLALEPPDLARRERRSDKN

SEQ ID NO: 4891 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattcgtacgctcgacacgctggagaagtacgttacactcaccgctgaagaagaagagggagtaaaagaatcgcccaaagtactccgaatggctatcacgccttattatttgagtttgataaaccccgagaatcctaatgatccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaggcagtggaggcttgtgaaagaatggccaatgccggtattccgttgggtaaccaaacggttttattgcgtggaatcaatgattgtacacgtgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaatttcgaaggtgttatcacaacctatacggagccggatgactatcatgaggagtgcgattgtgaggactgccgagtcgacaagcatcgtgagggcgtggctgcactttccggaggtcagcagttggctttagtgcctcccgacttagctcgcaaggaacgcaggagcgataagaactaa

SEQ ID NO: 4892 - protein, 416 aa, Artificial Sequence
  Description of Artificial Sequence: Synthetic Construct
MAESRRKHYFPDVTDEQWYDWHWQVINRIRTLDTLEKYVTLTAEEEEGVKESPKVLRMAITPYYLSLINPENPNDPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTRVMKRLVHLLVKIRVRPYYIYACDLSLGIGHFRTPVSKGIEIIENLRGHTSGYAVPTFVVHAPGGGGKIPVAPNYVVSQSPRHVVLRNFEGVITTYTEPDDYHEECDCEDCRVDKHREGVAALSGGQQLALVPPDLARKERRSDKN

SEQ ID NO: 4893 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaatgatccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcctcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacgtgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaatttcgaaggtgttatcacaacctatacggagccggatgactatcatgaggagtgcgattgtgaggactgccgagtcgacaagcatcgtgagggcgtggctgcactttccggaggtcagcagttggctttagagcctcccgacttagctcgcaaggaacgcaggagcgataagaactaa

SEQ ID NO: 4894 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNDPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTRVMKRLVHLLVKIRVRPYYIYACDLSLGIGHFRTPVSKGIEIIENLRGHTSGYAVPTFVVHAPGGGGKIPVAPNYVVSQSPRHVVLRNFEGVITTYTEPDDYHEECDCEDCRVDKHREGVAALSGGQQLALEPPDLARKERRSDKN

SEQ ID NO: 4895 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacgtgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatcccagtccccacgacatgtggttcttcgcaattatgaaggtgttatcacaacctatacggagccggatgactatcatgaggagtgcgattgtgaggactgccgagtcgacaagcatcgtattggcgtggctgcactttccggaggtcagcagttggctttagtgcctcccgacttagctcgcaaagaacgcaggagcgataagaactaa

SEQ ID NO: 4896 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTRVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPDDYHEECDCEDCRVDKHRIGVAALSGGQQLALVPPDLARKERRSDKN

SEQ ID NO: 4897 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaatgatccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacgtgtgatgaagagattggtacatttgctggtaaagattcgtgtgcgtccttactacatatatgcttgcgatctttcgcttggaataagccatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaatttcgaaggtgttatcacaacctatacggagccggatgactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4898 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNDPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTRVMKRLVHLLVKIRVRPYYIYACDLSLGISHFRTPVSKGIEIIENLRGHTSGYAVPTFVVHAPGGGGKIPVAPNYVVSQSPRHVVLRNFEGVITTYTEPDDYHEECDCEDCRVDKHREGVAALSGGQQLALEPPDLARKERRSDKN

SEQ ID NO: 4899 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattcgtacgctcgacacgctggagaagtacgttacactcaccgctgaagaagaagagggagtaaaagaatcgcccaaagtactccgaatggctatcacgccttattatttgagtttgatagaccccgagaatcctaatgatccgattcgtaaacaagccattcctactaaacgggaactggtacgtgctcctgaagatatggtagacccacttagtgaagacgaagattcgcccgtacccggactgactcatcgttatccggatcgtgtattgttccttatcacggacaaatgttcgatgtactgtcgtcattgtacccgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcagaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacgtgtgatgaagagattggtacatttgctggtaaagattcgtgtgcgtccttactacatatatgcttgcgatctttcgcttggaataagccatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaatttcgaaggtgttatcacaacctatacggagccggatgactatcatgaggagtgcgattgtgaggactgccgagtcgacaagcatcgtgagggcgtggctgcactttccggaggtcagcagttggctttagagcctcccgacttagctcgcatggaacgcaggagcgataagaactaa

SEQ ID NO: 4900 - protein, 416 aa, Artificial Sequence
  Description of Artificial Sequence: Synthetic Construct
MAESRRKHYFPDVTDEQWYDWHWQVINRIRTLDTLEKYVTLTAEEEEGVKESPKVLRMAITPYYLSLIDPENPNDPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLRKYHPVWLNTHFNHPNEVTEEAVEACERMANAGIPLGNQTVLLRGINDCTRVMKRLVHLLVKIRVRPYYIYACDLSLGISHFRTPVSKGIEIIENLRGHTSGYAVPTFVVHAPGGGGKIPVAPNYVVSQSPRHVVLRNFEGVITTYTEPDDYHEECDCEDCRVDKHREGVAALSGGQQLALEPPDLARMERRSDKN

SEQ ID NO: 4901 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaaaacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaataagccatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtattggcgtggctgcactttccggaggtcagcagttggctttagtgcctcccgacttagctcgcatggaacgcaggagcgataagaactaa

SEQ ID NO: 4902 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGISHFRTPVSKGIEIIENLRGHTSGYAVPTFVVHAPGGGGKIPVAPNYVVSQSPRHVVLRNYEGVITTYTEPEDYHEECDCEDCRVDKHRIGVAALSGGQQLALVPPDLARMERRSDKN

SEQ ID NO: 4903 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaaaacgctcgacctgctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaggaacgcaggagcgataagaactaa

SEQ ID NO: 4904 - protein, 416 aa, Artificial Sequence
  Description of Artificial Sequence: Synthetic Construct
MAESRRKHYFPDVTDEQWYDWHWQVINRIKTLDLLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4905 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacacccaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgcctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacgtgtgatgaagagattggtacatttgctggtaaagattcgtgtgcgtccttactacatatatgcttgcgatctttcgcttggaataagccatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtattggcgtggctgcactttccagcggtcagcagttggctttagtgcctcccgacttagctcgcatggaacgcaggagcgataagaactaa

SEQ ID NO: 4906 - protein, 416 aa, Artificial Sequence
  Description of Artificial Sequence: Synthetic Construct
MAESRRKHYFPDVTDEQWYDWHWQVINRIKTLDQLEKYVTPTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTRVMKRLVHLLVKIRVRPYYIYACDLSLGISHFRTPVSKGIEIIENLRGHTSGYAVPTFVVHAPGGGGKIPVAPNYVVSQSPRHVVLRNYEGVITTYTEPEDYHEECDCEDCRVDKHRIGVAALSSGQQLALVPPDLARMERRSDKN

SEQ ID NO: 4907 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattcgtacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacgtgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggatgactatcatgaggagtgcgattgtgaggactgccgagtcgacaagcatcgtattggcgtggctgcactttccagcggtcagcagttggctttagtgcctcccgacttagctcgcaaggaacgcaggagcgataagaactaa

SEQ ID NO: 4908 - protein, 416 aa, Artificial Sequence
  Description of Artificial Sequence: Synthetic Construct
MAESRRKHYFPDVTDEQWYDWHWQVINRIRTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTRVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPDDYHEECDCEDCRVDKHRIGVAALSSGQQLALVPPDLARKERRSDKN

SEQ ID NO: 4909 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaatgatccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaataagccatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggatgactatcatgaggagtgcgattgtgaggactgccgagtcgacaagcatcgtgagggcgtggctgcactttccggaggtcagcagttggctttagtgcctcccgacttagctcgcaaggaacgcaggagcgataagaactaa

SEQ ID NO: 4910 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNDPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGISHFRTPVSKGIEIIENLRGHTSGYAVPTFVVHAPGGGGKIPVAPNYVVSQSPRHVVLRNYEGVITTYTEPDDYHEECDCEDCRVDKHREGVAALSGGQQLALVPPDLARKERRSDKN

SEQ ID NO: 4911 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaaaacgctcgaccagctggagaagtacgttacactcaccgctgaagaagaagagggagtaaaagaatcgcccaaagtactccgaatggctatcacgccttattatttgagtttgatagaccccgagaatcctaatgatccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacgtgtgatgaagagattggtacatttgctggtaaagattcgtgtgcgtccttactacatatatgcttgcgatctttcgcttggaataagccatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaatttcgaaggtgttatcacaacctatacggagccggatgactatcatgaggagtgcgattgtgaggactgccgagtcgacaagcatcgtgagggcgtggctgcactttccagcggtcagcagttggctttagtgcctcccgacttagctcgcaaagaacgcaggagcgataagaactaa

SEQ ID NO: 4912 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNDPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTRVMKRLVHLLVKIRVRPYYIYACDLSLGISHFRTPVSKGIEIIENLRGHTSGYAVPTFVVHAPGGGGKIPVAPNYVVSQSPRHVVLRNFEGVITTYTEPDDYHEECDCEDCRVDKHREGVAALSSGQQLALVPPDLARKERRSDKN

SEQ ID NO: 4913 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattcgtacgctcgacacgctggagaagtacgttacactcaccgctgaagaagaagagggagtaaaagaatcgcccaaagtactccgaatggctatcacgccttattatttgagtttgatagaccccgagaatcctaatgatccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacgtgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggatgactatcatgaggagtgcgattgtgaggactgccgagtcgacaagcatcgtgagggcgtggctgcactttccggaggtcagcagttggctttagagcctcccgacttagctcgcatggaacgcaggagcgataagaactaa

SEQ ID NO: 4914 - protein, 416 aa, Artificial Sequence
  Description of Artificial Sequence: Synthetic Construct
MAESRRKHYFPDVTDEQWYDWHWQVINRIRTLDTLEKYVTLTAEEEEGVKESPKVLRMAITPYYLSLIDPENPNDPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTRVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPDDYHEECDCEDCRVDKHREGVAALSGGQQLALEPPDLARMERRSDKN

SEQ ID NO: 4915 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaatgatccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacgtgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacacgtggttcttcgcaatttcgaaggtgttatcacaacctatacggagccggatgactatcatgaggagtgcgattgtgaggactgccgagtcgacaagcatcgtattggcgtggctgcactttccggaggtcagcagttggctttagtgcctcccgacttagctcgcatggaacgcaggagcgataagaactaa

SEQ ID NO: 4916 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNDPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTRVMKRLVHLLVKIRVRPYYIYACDLSLGIGHFRTPVSKGIEIIENLRGHTSGYAVPTFVVHAPGGGGKIPVAPNYVVSQSPRHVVLRNFEGVITTYTEPDDYHEECDCEDCRVDKHRIGVAALSGGQQLALVPPDLARMERRSDKN

SEQ ID NO: 4917 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaataagccatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaatttcgaaggtgttatcacaacctatacggagccggaggactatcatgaggagtgcgattgtgaggactgccgagtcgacaagcatcgtgagggcgtggctgcactttccagcggtcagcagttggctttagagcctcccgacttagctcgcaaggaacgcaggagcgataagaactaa

SEQ ID NO: 4918 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGISHFRTPVSKGIEIIENLRGHTSGYAVPTFVVHAPGGGGKIPVAPNYVVSQSPRHVVLRNFEGVITTYTEPEDYHEECDCEDCRVDKHREGVAALSSGQQLALEPPDLARKERRSDKN

SEQ ID NO: 4919 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaaaacgctcgaccagctggagaagtacgttacactcaccgctgaagaagaagagggagtaaaagaatcgcccaaagtactccgaatggctatcacgccttattatttgagtttgatagaccccgagaatcctaatgatccgattcgtaaacaagccattcctactaaacgggaactggtacgtgctcctgaagacatggtagacccacttagtgaagatgaagattcgcccgtacccggactgactcatcgttatccggatcgtgtattgttccttatcacggacaaatgttcgatgtactgtcgtcattgtactcgccgtcgcttcgcggggcagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacgtgtgatgaagagattggtacatttgctggtaaagattcgtgtgcgtccttactacatatatgcttgcgatctttcgcttggaataagccatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggatgactatcatgaggagtgcgattgtgaggactgccgagtcgacaagcatcgtgagggcgtggctgcactttccggaggtcagcagttggctttagtgcctcccgacttagctcgcaaggaacgcaggagcgataagaactaa

SEQ ID NO: 4920 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNDPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTRVMKRLVHLLVKIRVRPYYIYACDLSLGISHFRTPVSKGIEIIENLRGHTSGYAVPTFVVHAPGGGGKIPVAPNYVVSQSPRHVVLRNYEGVITTYTEPDDYHEECDCEDCRVDKHREGVAALSGGQQLALVPPDLARKERRSDKN

SEQ ID NO: 4921 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaaaacgctcgacacgctggagaagtacgttacactcaccgctgaagaagaagagggagtaaaagaatcgcccaaagtactccgaatggctatcacgccttattatttgagtttgatagaccccgagaatcctaatgatccgattcgtaaacaagccattcctactaaacgggaactggtacgtgctcctgaagatatggtagacccacttagtgaagatgaagattcgcccgtacccggactgactcatcgttatccggaccgtgtattgttccttatcacggacaaatgttcgatgtactgtcgtcattgtactcgccgtcgcttcgcgggacagagggatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacgtgtgatgaagagattggtacatttgctggtaaagattcgtgtgcgtccttactacatatatgcttgcgatctttcgcttggaataagccatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggatgactatcatgaggagtgcgattgtgaggactgccgagtcgacaagcatcgtattggcgtggctgcactttccggaggtcagcagttggctttagtgcctcccgacttagctcgcatggaacgcaggagcgataagaactaa

SEQ ID NO: 4922 - protein, 416 aa, Artificial Sequence
  Description of Artificial Sequence: Synthetic Construct
MAESRRKHYFPDVTDEQWYDWHWQVINRIKTLDTLEKYVTLTAEEEEGVKESPKVLRMAITPYYLSLIDPENPNDPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTRVMKRLVHLLVKIRVRPYYIYACDLSLGISHFRTPVSKGIEIIENLRGHTSGYAVPTFVVHAPGGGGKIPVAPNYVVSQSPRHVVLRNYEGVITTYTEPDDYHEECDCEDCRVDKHRIGVAALSGGQQLALVPPDLARMERRSDKN

SEQ ID NO: 4923 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattcgtacgctcgacacgctggagaagtacgttacactcaccgctgaagaagaagagggagtaaaagaatcgcccaaagtactccgaatggctatcacgccttattatttgagtttgatagaccccgagaatcctaatgatccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaataagccatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggatgactatcatgaggagtgcgattgtgaggactgccgagtcgacaagcatcgtgagggcgtggctgcactttccggaggtcagcagttggctttagtgcctcccgacttagctcgcatggaacgcaggagcgataagaactaa

SEQ ID NO: 4924 - protein, 416 aa, Artificial Sequence
  Description of Artificial Sequence: Synthetic Construct
MAESRRKHYFPDVTDEQWYDWHWQVINRIRTLDTLEKYVTLTAEEEEGVKESPKVLRMAITPYYLSLIDPENPNDPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGISHFRTPVSKGIEIIENLRGHTSGYAVPTFVVHAPGGGGKIPVAPNYVVSQSPRHVVLRNYEGVITTYTEPDDYHEECDCEDCRVDKHREGVAALSGGQQLALVPPDLARMERRSDKN

SEQ ID NO: 4925 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaaaacgctcgaccagctggagaagtacgttacactcaccgctgaagaagaagagggagtaaaagaatcgcccaaagtactccgaatggctatcacgccttattatttgagtttgatagaccccgagaatcctaatgatccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaataagccatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggatgactatcatgaggagtgcgattgtgaggactgccgagtcgacaagcatcgtgagggcgtggctgcactttccggaggtcagcagttggctttagtgcctcccgacttagctcgcatggaacgcaggagcgataagaactaa

SEQ ID NO: 4926 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNDPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGISHFRTPVSKGIEIIENLRGHTSGYAVPTFVVHAPGGGGKIPVAPNYVVSQSPRHVVLRNYEGVITTYTEPDDYHEECDCEDCRVDKHREGVAALSGGQQLALVPPDLARMERRSDKN

SEQ ID NO: 4927 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacgtgtgatgaagagattggtacatttgctggtaaagattcgtgtgcgtccttactacatatatgcttgcgatctttcgcttggaataagccatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggatgactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4928 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTRVMKRLVHLLVKIRVRPYYIYACDLSLGISHFRTPVSKGIEIIENLRGHTSGYAVPTFVVHAPGGGGKIPVAPNYVVSQSPRHVVLRNYEGVITTYTEPDDYHEECDCEDCRVDKHREGVAALSGGQQLALEPPDLARKERRSDKN

SEQ ID NO: 4929 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaaaacgctcgacacgctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacgtgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacggcatgtggttcttcgcaatttcgaaggtgttatcacaacctatacggagccggaggactatcgtgaggagtgcgattgtgaggactgccgagtcgacaagcatcgtattggcgtggctgcactttccggaggtcagcagttggctttagagcctcccgacttagctcgcaaagaacgcaggagcgataagaactaa

SEQ ID NO: 4930 - protein, 416 aa, Artificial Sequence
  Description of Artificial Sequence: Synthetic Construct
MAESRRKHYFPDVTDEQWYDWHWQVINRIKTLDTLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTRVMKRLVHLLVKIRVRPYYIYACDLSLGIGHFRTPVSKGIEIIENLRGHTSGYAVPTFVVHAPGGGGKIPVAPNYVVSQSPRHVVLRNFEGVITTYTEPEDYREECDCEDCRVDKHRIGVAALSGGQQLALEPPDLARKERRSDKN

SEQ ID NO: 4931 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaaaacgctcgacctgctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacgtgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccagcggtcagcagttggctttagtgcctcccgacttagctcgcaaggaacgcaggagcgataagaactaa

SEQ ID NO: 4932 - protein, 416 aa, Artificial Sequence
  Description of Artificial Sequence: Synthetic Construct
MAESRRKHYFPDVTDEQWYDWHWQVINRIKTLDLLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTRVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSSGQQLALVPPDLARKERRSDKN

SEQ ID NO: 4933 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgacacgctggagaagtacgttacactcaccgctgaagaagaagagggagtaaaagaatcgcccaaagtactccgaatggctatcacgccttattatttgagtttgatagaccccgagaatcctaatgatccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaataagccatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggatgactatcatgaggagtgcgattgtgaggactgccgagtcgacaagcatcgtgagggcgtggctgcactttccggaggtcagcagttggctttagtgcctcccgacttagctcgcatggaacgcaggagcgataagaactaa

SEQ ID NO: 4934 - protein, 416 aa, Artificial Sequence
  Description of Artificial Sequence: Synthetic Construct
MAESRRKHYFPDVTDEQWYDWHWQVINRIKTLDTLEKYVTLTAEEEEGVKESPKVLRMAITPYYLSLIDPENPNDPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGISHFRTPVSKGIEIIENLRGHTSGYAVPTFVVHAPGGGGKIPVAPNYVVSQSPRHVVLRNYEGVITTYTEPDDYHEECDCEDCRVDKHREGVAALSGGQQLALVPPDLARMERRSDKN

SEQ ID NO: 4935 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgacctgctggagaagtacgttacactcaccgctgaagaagaagagggagtaaaagaatcgcccaaagtactccgaatggctatcacgccttattatttgagtttgatagaccccgagaatcctaatgatccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacgccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctcccccagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaataagccatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagtgcctcccgacttagctcgcaaggaacgcaggagcgataagaactaa

SEQ ID NO: 4936 - protein, 416 aa, Artificial Sequence
  Description of Artificial Sequence: Synthetic Construct
MAESRRKHYFPDVTDEQWYDWHWQVINRIKTLDLLEKYVTLTAEEEEGVKESPKVLRMAITPYYLSLIDPENPNDPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGISHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALVPPDLARKERRSDKN

SEQ ID NO: 4937 - DNA, 1251 bp, Artificial Sequence
  Description of Artificial Sequence: Synthetic Construct
atggcagaaagtcgtagaaagcattatttccccgatgtcaccgatgagcaatggtacgactggcattggcaggtcatcactcgaattaaaacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaataagccatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaatttcgaaggtgttatcacaacctatacggagccggaggactatcatgaggagtgcgattgtgaggactgccgagtcgacaagcatcgtgagggcgtggctgcactttccggaggtcagcagttggctttagtgcctcccgacttagctcgcaaagaacgcgggagcgataagaactaa

SEQ ID NO: 4938 - protein, 416 aa, Artificial Sequence
  Description of Artificial Sequence: Synthetic Construct
MAESRRKHYFPDVTDEQWYDWHWQVITRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGISHFRTPVSKGIEIIENLRGHTSGYAVPTFVVHAPGGGGKIPVAPNYVVSQSPRHVVLRNFEGVITTYTEPEDYHEECDCEDCRVDKHREGVAALSGGQQLALVPPDLARKERGSDKN

SEQ ID NO: 4939 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaaaacgctcgaccagctggagaagtacgttacactcaccgctgaagaagaagagggagtaaaagaatcgcccaaagtactccgaatggctatcacgccttattatttgagtttgatagaccccgagaatcctaatgatccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaataagccatttccgcacgccggtatctaagggaatcgaaattatcgaaaatttgcgcggacacacctcgggctatgcagttcctacctttgtggtgcatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccagcggtcagcagttggctttagtgcctcccgacttagctcgcatggaacgcaggagcgataagaactaa

SEQ ID NO: 4940 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNDPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGISHFRTPVSKGIEIIENLRGHTSGYAVPTFVVHAPGGGGKIPVAPNYVVSQSPRHVVLRNYEGVITTYTEPEDYHEECDCEDCRVDKHREGVAALSSGQQLALVPPDLARMERRSDKN

SEQ ID NO: 4941 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaatgatccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagcggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaataagccatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtattggcgtggctgcactttccggaggtcagcagttggctttagagcctcccgacttagctcgcaaagaacgcaggagcgataagaactaa

SEQ ID NO: 4942 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNDPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAAEACERMANAGIPLGNQTVLLRGINDCTHVMKRLVHLLVKIRVRPYYIYACDLSLGISHFRTPVSKGIEIIENLRGHTSGYAVPTFVVHAPGGGGKIPVAPNYVVSQSPRHVVLRNYEGVITTYTEPEDYHEECDCEDCRVDKHRIGVAALSGGQQLALEPPDLARKERRSDKN

SEQ ID NO: 4943 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgacacgctggagaagtacgttacactcaccgctgaagaagaagagggagtaaaagaatcgcccaaagtactccgaatggctatcacgccttattatttgagtttgataaaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacgtgtgatgaagagattggtacatttgctggtaaagattcgtgtgcgtccttactacatatatgcttgcgatctttcgcttggaataagccatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggatgactatcatgaggagtgcgattgtgaggactgccgagtcgacaagcatcgtgagggcgtggctgcactctccggaggtcagcagttggctttagtgcctcccgacttagctcgcaaagaacgcaggagcgataagaactaa

SEQ ID NO: 4944 - protein, 416 aa, Artificial Sequence
  Description of Artificial Sequence: Synthetic Construct
MAESRRKHYFPDVTDEQWYDWHWQVINRIKTLDTLEKYVTLTAEEEEGVKESPKVLRMAITPYYLSLINPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTRVMKRLVHLLVKIRVRPYYIYACDLSLGISHFRTPVSKGIEIIENLRGHTSGYAVPTFVVHAPGGGGKIPVAPNYVVSQSPRHVVLRNYEGVITTYTEPDDYHEECDCEDCRVDKHREGVAALSGGQQLALVPPDLARKERRSDKN

SEQ ID NO: 4945 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaaaacgctcgacctgctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacgtgtgatgaagagattggtacatttgctggtaaagattcgtgtgcgtccttactacatatatgcttgcgatctttcgcttggaataagccatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgtatggaacgcaggagcgataagaactaa

SEQ ID NO: 4946 - protein, 416 aa, Artificial Sequence
  Description of Artificial Sequence: Synthetic Construct
MAESRRKHYFPDVTDEQWYDWHWQVINRIKTLDLLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTRVMKRLVHLLVKIRVRPYYIYACDLSLGISHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARMERRSDKN

SEQ ID NO: 4947 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaaaacgcccgaccagctggagaagtacgttacactcaccgctgaagaagaagagggagtaaaagaatcgcccaaagtactccgaatggctatcacgccttattatttgagtttgatagaccccgagaatcctaatgatccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacgtgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaatttcgaaggtgttatcacaacctatacggagccggatgactatcatgaggagtgcgattgtgaggactgccgagtcgacaagcatcgtattggcgtggctgcactttccggaggtcagcagttggctttagagcctcccgacttagctcgcaaagaacgcaggagcgataagaactaa

SEQ ID NO: 4948 - protein, 416 aa, Artificial Sequence
  Description of Artificial Sequence: Synthetic Construct
MAESRRKHYFPDVTDEQWYDWHWQVINRIKTPDQLEKYVTLTAEEEEGVKESPKVLRMAITPYYLSLIDPENPNDPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTRVMKRLVHLLVKIRVRPYYIYACDLSLGIGHFRTPVSKGIEIIENLRGHTSGYAVPTFVVHAPGGGGKIPVAPNYVVSQSPRHVVLRNFEGVITTYTEPDDYHEECDCEDCRVDKHRIGVAALSGGQQLALEPPDLARKERRSDKN

SEQ ID NO: 4949 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaatgatccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacgtgtgatgaagagattggtacatttgctggtaaagattcgtgtgcgtccttactacatatatgcttgcgatctttcgcttggattaagccatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaatttcgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcatggaacgcaggagcgataagaactaa

SEQ ID NO: 4950 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNDPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTRVMKRLVHLLVKIRVRPYYIYACDLSLGLSHFRTPVSKGIEIIENLRGHTSGYAVPTFVVHAPGGGGKIPVAPNYVVSQSPRHVVLRNFEGVITTYTEPEDYHEECDCEDCRVDKHREGVAALSGGQQLALEPPDLARMERRSDKN

SEQ ID NO: 4951 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaaaacgctcgacacgctggagaagtacgttacactcaccgctgaagaagaagagggagtaaaagaatcgcccaaagtactccgaatggctatcacgccttattatttgagtttgatagaccccgagaatcctaatgatccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaataagccatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggatgactatcatgaggagtgcgattgtgaggactgccgagtcgacaagcatcgtattggcgtggctgcactttccggaggtcagcagttggctttagtgcctcccgacttagctcgcatggaacgcaggagcgataagaactaa

SEQ ID NO: 4952 - protein, 416 aa, Artificial Sequence
  Description of Artificial Sequence: Synthetic Construct
MAESRRKHYFPDVTDEQWYDWHWQVINRIKTLDTLEKYVTLTAEEEEGVKESPKVLRMAITPYYLSLIDPENPNDPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGISHFRTPVSKGIEIIENLRGHTSGYAVPTFVVHAPGGGGKIPVAPNYVVSQSPRHVVLRNYEGVITTYTEPDDYHEECDCEDCRVDKHRIGVAALSGGQQLALVPPDLARMERRSDKN

SEQ ID NO: 4953 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgacacgctggagaagtacgttacactcaccgctgaagaagaagagggagtaaaagaatcgcccaaagtactccgaatggctatcacgccttattatttgagtttgataaaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacgtgtgatgaagagattggtacatttgctggtaaagattcgtgtgcgtccttactacatatatgcttgcgatctttcgcttggaataagccatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaatttcgaaggtgttatcacaacctatacggagccggaggactatcatgaggagtgcgattgtgaggactgccgagtcgacaagcatcgtgagggcgtggctgcactttccggaggtcagcagttggctttagtgcctcccgacttagctcgcatggaacgcaggagcgataagaactaa

SEQ ID NO: 4954 - protein, 416 aa, Artificial Sequence
  Description of Artificial Sequence: Synthetic Construct
MAESRRKHYFPDVTDEQWYDWHWQVINRIKTLDTLEKYVTLTAEEEEGVKESPKVLRMAITPYYLSLINPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTRVMKRLVHLLVKIRVRPYYIYACDLSLGISHFRTPVSKGIEIIENLRGHTSGYAVPTFVVHAPGGGGKIPVAPNYVVSQSPRHVVLRNFEGVITTYTEPEDYHEECDCEDCRVDKHREGVAALSGGQQLALVPPDLARMERRSDKN

SEQ ID NO: 4955 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacgtgtgatgaagagattggtacatttgctggtaaagattcgtgtgcgtccttactacatatatgcttgcgatctttcgcttggaataagccatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaatttcgaaggtgttatcacaacctatacggagccggatgactatcatgaggagtgcgattgtgaggactgccgagtcgacaagcatcgtattggcgtggctgcactttccggaggtcagcagttggctttagagcctcccgacttagctcgcatggaacgcaggagcgataagaactaa

SEQ ID NO: 4956 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTRVMKRLVHLLVKIRVRPYYIYACDLSLGISHFRTPVSKGIEIIENLRGHTSGYAVPTFVVHAPGGGGKIPVAPNYVVSQSPRHVVLRNFEGVITTYTEPDDYHEECDCEDCRVDKHRIGVAALSGGQQLALEPPDLARMERRSDKN

SEQ ID NO: 4957 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgtcggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaataagccatttccgcacgccggtatctaagggaatcgaaattatcgaaaatttgcgcggacacacctcgggctatgcagttcctacctttgtggtacatgctccggggggtggtggtaagatacctgcagcgccgaactatgttgtatctcagtccccacgacatgtggttcttcgcaattatgaaggtgttatcacaacctatacggagccggatgactatcatgaggagtgcgattgtgaggactgccgagtcgacaagcatcgtgagggcgtggctgcactttccggaggtcagcagttggctttagtgcctcccgacttagctcgcatggaacgcaggagcgataagaactaa

SEQ ID NO: 4958 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRASVVLPQRITPQLVDMLKKYHPVWLNTHFNHPNEVTEEAVEACERMANAGIPLGNQTVLLRGINDCTHVMKRLVHLLVKIRVRPYYIYACDLSLGISHFRTPVSKGIEIIENLRGHTSGYAVPTFVVHAPGGGGKIPAAPNYVVSQSPRHVVLRNYEGVITTYTEPDDYHEECDCEDCRVDKHREGVAALSGGQQLALVPPDLARMERRSDKN

SEQ ID NO: 4959 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaaaacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacgtgtgatgaagagattggtacatttgctggtaaagattcgtgtgcgtccttactacatatatgcttgcgatctttcgcttggaataagccatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggatgactatcatgaggagtgcgattgtgaggactgccgagtcgacaagcatcgtgagggcgtggctgcactttccggaggtcagcagttggctttagggcctcccgacttagctcgcatggaacgcaggagcgataagaactaa

SEQ ID NO: 4960 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTRVMKRLVHLLVKIRVRPYYIYACDLSLGISHFRTPVSKGIEIIENLRGHTSGYAVPTFVVHAPGGGGKIPVAPNYVVSQSPRHVVLRNYEGVITTYTEPDDYHEECDCEDCRVDKHREGVAALSGGQQLALGPPDLARMERRSDKN

SEQ ID NO: 4961 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaaaacgctcgacctgctggagaagtacgttacactcaccgctgaagaagaagagggagtaaaagaatcgcccaaagtactccgaatggctatcacgccttattatttgagtttgatagaccccgagaatcctaatgatccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaataagccatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggatgactatcatgaggagtgcgattgtgaggactgccgagtcgacaagcatcgtattggcgtggctgcactttccggaggtcagcagttggctttagtgcctcccgacttagctcgcaaagaacgcaggagcgataagaactaa

SEQ ID NO: 4962 - protein, 416 aa, Artificial Sequence
  Description of Artificial Sequence: Synthetic Construct
MAESRRKHYFPDVTDEQWYDWHWQVINRIKTLDLLEKYVTLTAEEEEGVKESPKVLRMAITPYYLSLIDPENPNDPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGISHFRTPVSKGIEIIENLRGHTSGYAVPTFVVHAPGGGGKIPVAPNYVVSQSPRHVVLRNYEGVITTYTEPDDYHEECDCEDCRVDKHRIGVAALSGGQQLALVPPDLARKERRSDKN

SEQ ID NO: 4963 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaaaacgctcgacacgctggagaagtacgttacactcaccgctgaagaagaagagggagtaaaagaatcgcccaaagtactccgaatggctatcacgccttattatttgagtttgatagaccccgagaatcctaatgatccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaatttcgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4964 - protein, 416 aa, Artificial Sequence
  Description of Artificial Sequence: Synthetic Construct
MAESRRKHYFPDVTDEQWYDWHWQVINRIKTLDTLEKYVTLTAEEEEGVKESPKVLRMAITPYYLSLIDPENPNDPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNFEGVITTYTEPEDYHEECDCEDCRVDKHREGVAALSGGQQLALEPPDLARKERRSDKN

SEQ ID NO: 4965 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccgaatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacgtgtgatgaagagattggtacatttgctggtaaagattcgtgtgcgtccttactacatatatgcttgcgatctttcgcttggaataagccatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggatgactatcatgaggagtgcgattgtgaggactgccgagtcgacaagcatcgtattggcgtggctgcactttccggaggtcagcagttggctttagtgcctcccgacttagctcgcaaagaacgcaggagcgataagaactaa

SEQ ID NO: 4966 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPNRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTRVMKRLVHLLVKIRVRPYYIYACDLSLGISHFRTPVSKGIEIIENLRGHTSGYAVPTFVVHAPGGGGKIPVAPNYVVSQSPRHVVLRNYEGVITTYTEPDDYHEECDCEDCRVDKHRIGVAALSGGQQLALVPPDLARKERRSDKN

SEQ ID NO: 4967 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacgtgtgatgaagagattggtacatttgctggtaaagactcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacgtgtggttcttcgcaatttcgaaggtgttatcacaacctatacggagccggaggactatcatgaggagtgcgattgtgaggactgccgagtcgacaagcatcgtattggcgtggctgcactttccggaggtcagcagttggctttagtgcctcccgacttagctcgcaaagaacgcaggagcgataagaactaa

SEQ ID NO: 4968 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTRVMKRLVHLLVKTRVRPYYIYACDLSLGIGHFRTPVSKGIEIIENLRGHTSGYAVPTFVVHAPGGGGKIPVAPNYVVSQSPRRVVLRNFEGVITTYTEPEDYHEECDCEDCRVDKHRIGVAALSGGQQLALVPPDLARKERRSDKN

SEQ ID NO: 4969 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattattcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaacgtctggccaatgccggtattccgttgggtaaccaaacggttttattgcgtggaatcaatgattgtgcacatgtgatgaagagattggtacatttgctggtaaacattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4970 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIIRIGSRAPVVLPQRITPQLVDMLKKYHPVWLNTHFNHPNEVTEEAVEACERLANAGIPLGNQTVLLRGINDCAHVMKRLVHLLVNIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4971 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattattcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaacgtatggccaatgccggtattccgttgggtaaccaaacggttttattgcgtggaatcaatgattgtacacatgtgatgaagagattggtacatttgctggtaaacattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataaggactaa

SEQ ID NO: 4972 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIIRIGSRAPVVLPQRITPQLVDMLKKYHPVWLNTHFNHPNEVTEEAVEACERMANAGIPLGNQTVLLRGINDCTHVMKRLVHLLVNIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKD

SEQ ID NO: 4973 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaaatcaccgaagaagcagtggaggcttgtgaacgtctggccaataccggtgtgccgttgggtaaccaaacggttttattgcgtggaatcaatgattgtacacatgtgatgaagagattggtacatttgctggtaaacattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacatagctcgcaaagaacgcaggagcgataagaactaa

SEQ ID NO: 4974 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEITEEAVEACERLANTGVPLGNQTVLLRGINDCTHVMKRLVHLLVNIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDIARKERRSDKN

SEQ ID NO: 4975 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattattcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaacgtatggccaatgccggtgtgccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4976 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIIRIGSRAPVVLPQRITPQLVDMLKKYHPVWLNTHFNHPNEVTEEAVEACERMANAGVPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4977 - DNA, 1251 bp, Artificial Sequence
  Description of Artificial Sequence: Synthetic Construct
atggcagaaagtcgtagaaagcattatttccctgatgtcaccgatgagcactggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcacgggacagagagatgcttcttctccttctgagcgcatcgatcgatgcattgagtatatagccaatacaccgacagtccgcgatgtcttgctatcgggaggcgatgccctccttgtcagcgacgaacgcttggaatacatactgaagcgtctgcgcgaagtacctcatgtggagattattcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtgtgccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4978 - protein, 416 aa, Artificial Sequence
  Description of Artificial Sequence: Synthetic Construct
MAESRRKHYFPDVTDEHWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFTGQRDASSPSERIDRCIEYIANTPTVRDVLLSGGDALLVSDERLEYILKRLREVPHVEIIRIGSRAPVVLPQRITPQLVDMLKKYHPVWLNTHFNHPNEVTEEAVEACERMANAGVPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4979 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattattcgtataggaagccgtgcgccggtagtcctccctcagcgtataacgcctcaattggtggatatgctcaaaaaatatcatccggtgtgggtcaacactcacttcaaccacccgaatgaagttaccgaagaagcagtggaggcttgtgaaatgatggccaatgccggtgtgccgttgggtaaccaaacggttttattgcgtggaatcaatgattgtacacatgtgatgaagagattggtacatttgctggtaaacattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4980 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIIRIGSRAPVVLPQRITPQLVDMLKKYHPVWVNTHFNHPNEVTEEAVEACEMMANAGVPLGNQTVLLRGINDCTHVMKRLVHLLVNIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4981 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtgtaggaagccgtgcgccggtagtcctccctcagcgtataacgcctcaattggtggatatgctcaaaaaatatcatccggtgtggctgaacactcacttcaaccacccgaatgaaatcaccgaagaagcagtggaggcttgtgaaagaatggccaatgccggtgtgccgttgggtaaccaaacggttttattgcgtggaatcaatgattgtacacatgtgatgaagagattggtacatttgctggtaaacattcgtgtgcgtccttactacatatatgcttgcgatctttcgcttggaacagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4982 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRVGSRAPVVLPQRITPQLVDMLKKYHPVWLNTHFNHPNEITEEAVEACERMANAGVPLGNQTVLLRGINDCTHVMKRLVHLLVNIRVRPYYIYACDLSLGTGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4983 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgtcttgctatcgggaggcgatgccctccttgtcagcgacgaacgcttggaatacatactgaagcgtctgcgcgaagtacctcatgtggagattattcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaacgtatggccaatgccggtgtgccgttgggtaaccaaacggttttattgcgtggaatcaatgattgtacacatgtgatgaagagattggtacatttgctggtaaacattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtggggactgccgagtcgacaagcatcgtgagggcgtggctgcactttccggaggtcagcagttggctttagagcctcccgacttagctcgcaaagaacgcaggagcgataagaactaa

SEQ ID NO: 4984 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIIRIGSRAPVVLPQRITPQLVDMLKKYHPVWLNTHFNHPNEVTEEAVEACERMANAGVPLGNQTVLLRGINDCTHVMKRLVHLLVNIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCGDCRVDKHREGVAALSGGQQLALEPPDLARKERRSDKN

SEQ ID NO: 4985 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtgggtcaacactcacttcaaccacccgaatgaaatcaccgaagaagcagtggaggcttgtgaaagaatggccaatgccggtattccgttgggtaaccaaacggttttattgcgtggaatcaatgattgtacacatgtgatgaagagattggtacatttgctggtaaacattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4986 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWVNTHFNHPNEITEEAVEACERMANAGIPLGNQTVLLRGINDCTHVMKRLVHLLVNIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4987 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattattcgtataggaagccgtgcgccggtagtcctccctcagcgtataacgcctcaattggtggatatgctcaaaaaatatcatccggtgtggctgaacactcacttcaaccacccgaatgaaatcaccgaagaagcagtggaggcttgtgaaaagctggccaatgccggtattccgttgggtaaccaaacggttttattgcgtggaatcaatgattgtacacatgtgatgaagagattggtacatttgctggtaaacattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4988 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIIRIGSRAPVVLPQRITPQLVDMLKKYHPVWLNTHFNHPNEITEEAVEACEKLANAGIPLGNQTVLLRGINDCTHVMKRLVHLLVNIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4989 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgcgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagtgtctgcgcgaagtacctcatgtggagattattcgtataggaagccgtgcgccggtagtcctccctcagcgtataacgcctcaattggtggatatgctcaaaaaatatcatccggtgtgggtcaacactcacttcaaccacccgaatgaaatcaccgaagaagcagtggaggcttgtgaaagaatggccaatgccggtattccgttgggtaaccaaacggttttattgcgtggaatcaatgattgtacacatgtgatgaagagattggtacatttgctggtaaacattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4990 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKCLREVPHVEIIRIGSRAPVVLPQRITPQLVDMLKKYHPVWVNTHFNHPNEITEEAVEACERMANAGIPLGNQTVLLRGINDCTHVMKRLVHLLVNIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4991 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactggagcgtctgcgcgaagtacctcatgtggagattgttcgtataggaagccgtgcgccggtagtcctccctcagcgtataacgcctcaattggtggatatgctcaaaaagtatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaacattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4992 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILERLREVPHVEIVRIGSRAPVVLPQRITPQLVDMLKKYHPVWLNTHFNHPNEVTEEAVEACERMANAGIPLGNQTVLLRGINDCTHVMKRLVHLLVNIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4993 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagacgaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattattcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaatgatggccaatgccggtgtgccgttgggtaaccaaacggttttattgcgtggaatcaatgattgtacacatgtgatgaagagattggtacatttgctggtaaacattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4994 - protein, 416 aa, Artificial Sequence
  Description of Artificial Sequence: Synthetic Construct
MAESRRKHYFPDVTDEQWYDWHWQVINRIKTLDQLEKYVTLTAEDEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIIRIGSRAPVVLPQRITPQLVDMLKKYHPVWLNTHFNHPNEVTEEAVEACEMMANAGVPLGNQTVLLRGINDCTHVMKRLVHLLVNIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4995 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaacgtatggccaatgccggtgtgccgttgggtaaccaaacggttttattgcgtggaatcaatgattgtacacatgtgatgaagagattggtacatttgctggtaaacattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4996 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGVPLGNQTVLLRGINDCTHVMKRLVHLLVNIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4997 - DNA, 1251 bp, Artificial Sequence
  Description of Artificial Sequence: Synthetic Construct
atggcagaaagtcgtagaaagcattatttcccagatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattattcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaatgctggccaatgccggtattccgttgggtaaccaaacggttttattgcgtggaatcaatgattgtacacatgtgatgaagagattggtacatttgctggtaaacattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 4998 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIIRIGSRAPVVLPQRITPQLVDMLKKYHPVWLNTHFNHPNEVTEEAVEACEMLANAGIPLGNQTVLLRGINDCTHVMKRLVHLLVNIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 4999 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattattcgtataggaagccgtgcgccggtagtcctccctcagcgtataacgcctcaattggtggatacgctcaaaaaatatcatccggtgtggctgaacactcacttcaaccacccgaatgaagttaccgaagaagcagtggaggcttgtgaaatgatggccaatgccggtgtgccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggtgtggctgcactttccggaggtcagcagttggctttagagcctcccgacttagctcgcaaagaacgcaggagcgataagaactaa

SEQ ID NO: 5000 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIIRIGSRAPVVLPQRITPQLVDTLKKYHPVWLNTHFNHPNEVTEEAVEACEMMANAGVPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5001 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgatccgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattattcgtataggaagccgtgcgccggtagtcctccctcagcgtataacgcctcaattggtggatatgctcaaaaaatatcatccggtgtgggtcaacactcacttcaaccacccgaatgaagttaccgaagaagcagtggaggcttgtgaaatgatggccaatgccggtgtgccgttgggtaaccaaacggttttattgcgtggaatcaatgattgtacacatgtgatgaagagattggtacatttgctggtaaacattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5002 - protein, 416 aa, Artificial Sequence; identical to SEQ ID NO: 4980
  Description of Artificial Sequence: Synthetic Construct

SEQ ID NO: 5003 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaaatcaccgaagaagcagtggaggcttgtgaacgtatggccaatgccggtattccgttgggtaaccaaacggttttattgcgtggaatcaatgattgtacacatgtgatgaagagattggtacatttgctggtaaacattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattacgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagtgataagaactaa

SEQ ID NO: 5004 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEITEEAVEACERMANAGIPLGNQTVLLRGINDCTHVMKRLVHLLVNIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5005 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattattcgtataggaagccgtgcgccggtagtcctccctcagcgtataacgcctcaattggtggatatgctcaaaaaatatcatccggtgtgggtcaacactcacttcaaccacccgaatgaagttaccgaagaagcagtggaggcttgtgaacgtatggccaatgccggtattccgttgggtaaccaaacggttttattgcgtggaatcaatgattgtacacatgtgatgaagagattggtacatttgctggtaaacattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5006 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIIRIGSRAPVVLPQRITPQLVDMLKKYHPVWVNTHFNHPNEVTEEAVEACERMANAGIPLGNQTVLLRGINDCTHVMKRLVHLLVNIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5007 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggaggagtacgttacactcaccgctgaagaagaagagggagtaaaagaatcgcccaacgtactccgaatggctatcacgccctattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattattcgtataggaagccgtgcgccggtagtcctccctcagcgtataacgcctcaattggtggatatgctcaaaaaatatcatccggtgtgggtcaacactcacttcaaccacccgaatgaagttaccgaagaagcagtggaggcttgtgaacgtatggccaatgccggtattccgttgggtaaccaaacggttttattgcgtggaatcaatgattgtacacatgtgatgaagagattggtacatttgctggtaaacattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5008 - protein, 416 aa, Artificial Sequence
  Description of Artificial Sequence: Synthetic Construct
MAESRRKHYFPDVTDEQWYDWHWQVINRIKTLDQLEEYVTLTAEEEEGVKESPNVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIIRIGSRAPVVLPQRITPQLVDMLKKYHPVWVNTHFNHPNEVTEEAVEACERMANAGIPLGNQTVLLRGINDCTHVMKRLVHLLVNIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5009 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattattcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtgtgccgttgggtaaccaaacggttttattgcgtggaatcaatgattgtacacatgtgatgaagagattggtacatttgctggtaaacattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5010 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIIRIGSRAPVVLPQRITPQLVDMLKKYHPVWLNTHFNHPNEVTEEAVEACERMANAGVPLGNQTVLLRGINDCTHVMKRLVHLLVNIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5011 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtgggtcaacactcacttcaaccacccgaatgaaatcaccgaagaagcagtggaggcttgtgaacgtctggccaatgccggtattccgttgggtaaccaaacggttttattgcgtggaatcaatgattgtacacatgtgatgaagagattggtacatttgctggtaaacattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgcgagggcgtggctgcactttccggaggtcagcagttggctttggagcctcccgacttagctcgcaaagaacgcaggagcgataagaactaa

SEQ ID NO: 5012 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWVNTHFNHPNEITEEAVEACERLANAGIPLGNQTVLLRGINDCTHVMKRLVHLLVNIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5013 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattattcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaacgtatggccaatgccggtgtgccgttgggtaaccaaacggttttattgcgtggaatcaatgattgtacacatgtgatgaagagattggtacatttgctggtaaacattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5014 - protein, 416 aa, Artificial Sequence; identical to SEQ ID NO: 5010
  Description of Artificial Sequence: Synthetic Construct

SEQ ID NO: 5015 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattattcgtataggaagccgtgcgccggtagtcctccctcagcgtataacgcctcaattggtggatatgctcaaaaaatatcatccggtgtgggtcaacactcacttcaaccacccgaatgaaatcaccgaagaagcagtggaggcttgtgaaagaatggccaatgccggtgtgccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaaccgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5016 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIIRIGSRAPVVLPQRITPQLVDMLKKYHPVWVNTHFNHPNEITEEAVEACERMANAGVPLGNQTVLLRGINDCTHVMKRLVHLLVKIRVRPYYIYACDLSLGIGHFRTPVSKGTEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5017 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagcttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattattcgtataggaagccgtgcgccggtagtcctccctcagcgtataacgcctcaattggtggatatgctcaaaaaatatcatccggtgtgggtcaacactcacttcaaccacccgaatgaagttaccgaagaagcagtggaggcttgtgaaatgatggccaatgccggtattccgttgggtaaccaaacggttttattgcgtggaatcaatgattgtacacatgtgatgaagagattggtacatttgctggtaaacattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5018 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIIRIGSRAPVVLPQRITPQLVDMLKKYHPVWVNTHFNHPNEVTEEAVEACEMMANAGIPLGNQTVLLRGINDCTHVMKRLVHLLVNIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5019 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattattcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaacgtatggccaatgccggtgtgccgttgggtaaccaaacggttttattgcgtggaatcaatgattgtacacatgtgatgaagagattggtacatttgctggtaaacattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcaccttccggaggtcagcagttggctttagagcctcccgacttagctcgcaaagaacgcaggagcgataagaactaa

SEQ ID NO: 5020 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIIRIGSRAPVVLPQRITPQLVDMLKKYHPVWLNTHFNHPNEVTEEAVEACERMANAGVPLGNQTVLLRGINDCTHVMKRLVHLLVNIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAAPSGGQQLALEPPDLARKERRSDKN

SEQ ID NO: 5021 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaggattcgcccgtacccggtctgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattattcgtataggaagccgtgcgccggtagtcctccctcagcgtataacgcctcaattggtggatatgctcaaaaaatatcatccggtgtggctgaacactcacttcaaccacccgaatgaaatcaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5022 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIIRIGSRAPVVLPQRITPQLVDMLKKYHPVWLNTHFNHPNEITEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5023 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattattcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaatgatggccaatgccggtattccgttgggtaaccaaacggttttattgcgtggaatcaatgattgtacacatgtgatgaagagattggtacatttgctggtaaacattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5024 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIIRIGSRAPVVLPQRITPQLVDMLKKYHPVWLNTHFNHPNEVTEEAVEACEMMANAGIPLGNQTVLLRGINDCTHVMKRLVHLLVNIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5025 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatgctgaagcgtctgcgcgaagtacctcatgtggagattattcgtataggaagccgtgcgccggtagtcctccctcagcgtataacgcctcaattggtggatatgctcaaaaaatatcatccggtgtggctgaacactcacttcaaccacccgaatgaaatcaccgaagaagcagtggaggcttgtgaaagaatggccaatgccggtattccgttgggtaaccaaacggttttattgcgtggaatcaatgattgtacacatgtgatgaagagattggtacatttgctggtaaacattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5026 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYMLKRLREVPHVEIIRIGSRAPVVLPQRITPQLVDMLKKYHPVWLNTHFNHPNEITEEAVEACERMANAGIPLGNQTVLLRGINDCTHVMKRLVHLLVNIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5027 - DNA, 1251 bp, Artificial Sequence
  Description of Artificial Sequence: Synthetic Construct
atggcagaaagtcgtagaaagcattatttccctgatgtaaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattattcgtataggaagccgtgcgccggtagtcctccctcagcgtataacgcctcaattggtggatatgctcaaaaaatatcatccggtgtggctgaacactcacttcaaccacccgaatgaaatcaccgaagaagcagtggaggcttgtgaaagaatggccaatgccggtattccgttgggtaaccaaacggttttattgcgtggaatcaatgattgtacacatgtgatgaagagattggtacatttgctggtaaacattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5028 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIIRIGSRAPVVLPQRITPQLVDMLKKYHPVWLNTHFNHPNEITEEAVEACERMANAGIPLGNQTVLLRGINDCTHVMKRLVHLLVNIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5029 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattattcgtataggaagccgtgcgccggtagtcctccctcagcgtataacgcctcaattggtggatatgctcaaaaaatatcatccggtgtggctgaacactcacttcaaccacccgaatgaaatcaccgaagaagcagtggaggcttgtgaacgtatggccaatgccggtattccgttgggtaaccaaacggttttattgcgtggaatcaatgattgtacacatgtgatgaagagattggtacatttgctggtaaacattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5030 - protein, 416 aa, Artificial Sequence; identical to SEQ ID NO: 5028
  Description of Artificial Sequence: Synthetic Construct

SEQ ID NO: 5031 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgttgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaacgtctggccaatgccggtattccgttgggtaaccaaacggttttattgcgtggaatcaatgattgtacacatgtgatgaagagattggtacatttgctggtaaacattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5032 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSLYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERLANAGIPLGNQTVLLRGINDCTHVMKRLVHLLVNIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5033 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtgttgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtgggtcaacactcacttcaaccacccgaatgaaatcaccgaagaagcagtggaggcttgtgaacgtctggccaatgccggtattccgttgggtaaccaaacggttttattgcgtggaatcaatgattgtacacatgtgatgaagagattggtacatttgctggtaaacattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5034 - protein, 416 aa, Artificial Sequence; identical to SEQ ID NO: 5012
  Description of Artificial Sequence: Synthetic Construct

SEQ ID NO: 5035 - DNA, 1251 bp, Artificial Sequence
  Description of Artificial Sequence: Synthetic Construct
atggcagaaagtcgtagaaagcatcatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaacattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5036 - protein, 416 aa, Artificial Sequence
  Description of Artificial Sequence: Synthetic Construct
MAESRRKHHFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVNIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5037 - DNA, 1251 bp, Artificial Sequence
  Description of Artificial Sequence: Synthetic Construct
atggcagcaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtgggtcaacactcacttcaaccacccgaatgaaatcaccgaagaagcagtggaggcttgtgaacgtctggccaatgccggtattccgttgggtaaccaaacggttttattgcgtggaatcaatgattgtacacatgtgatgaagagattggtacatttgctggtaaacattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5038 - protein, 416 aa, Artificial Sequence
  Description of Artificial Sequence: Synthetic Construct
MAASRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWVNTHFNHPNEITEEAVEACERLANAGIPLGNQTVLLRGINDCTHVMKRLVHLLVNIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5039 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattattcgtataggaagccgtgcgccggtagtcctccctcagcgtataacgcctcaattggtggatatgctcaaaaaatatcatccggtgtggctgaacactcacttcaaccacccgaatgaaatcaccgaagaagcagtggaggcttgtgaaagaatggccaatgccggtattccgttgggtaaccaaacggttttattgcgtggaatcaatgattgtacacatgtgatgaagagattggtacatttgctggtaaacattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagctggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5040 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIIRIGSRAPVVLPQRITPQLVDMLKKYHPVWLNTHFNHPNEITEEAVEACERMANAGIPLGNQTVLLRGINDCTHVMKRLVHLLVNIRVRPYYIYACDLSLGIGHFRTPVSKGIEIIENLRGHTSGYAVPTFVVHAPGGGGKIPVAPNYVVSQSPRHVVLRNYEGVITTYTELEDYHEECDCEDCRVDKHREGVAALSGGQQLALEPPDLARKERRSDKN

SEQ ID NO: 5041 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattattcgtataggaagccgtgcgccggtagtcctccctcagcgtataacgcctcaattggtggatatgctcaaaaaatatcatccggtgtgggtcaacactcacttcaaccacccgaatgaagttaccgaagaagcagtggaggcttgtgaacgtatggccaatgccggtattccgttgggtaaccaaacggttttattgcgtggaatcaatgattgtacacatgtgatgaagagattggtacatttgcttgtaaacattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5042 - protein, 416 aa, Artificial Sequence; identical to SEQ ID NO: 5006
  Description of Artificial Sequence: Synthetic Construct

SEQ ID NO: 5043 - DNA, 1251 bp, Artificial Sequence
  Description of Artificial Sequence: Synthetic Construct
atgactgaaagtcgtagaaagcattatttccctgatgtcaccgatgagcaatggtacgactggcattggcaggtcatcaatcgaattaagactctcgaccagctggagaagtacgtcacactcaccgttgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaataagccatttccgcacgccggtatctaagggaatcgaaattatcgaaaatttgcgcggacacacctcgggctatgcagttcctacctttgtggcacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtattggcgtggctgcactttccggaggtcagcagttggctttagagcctcccgacttagctcgcatggaacgcaggagcgataagaactag

SEQ ID NO: 5044 - protein, 416 aa, Artificial Sequence
  Description of Artificial Sequence: Synthetic Construct
MTESRRKHYFPDVTDEQWYDWHWQVINRIKTLDQLEKYVTLTVEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGISHFRTPVSKGIEIIENLRGHTSGYAVPTFVAHAPGGGGKIPVAPNYVVSQSPRHVVLRNYEGVITTYTEPEDYHEECDCEDCRVDKHRIGVAALSGGQQLALEPPDLARMERRSDKN

SEQ ID NO: 5045 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaaaacgctcgacacgctggagaagtacgttacactcaccgctgaagaagaagagggagtaaaagaatcgcccaaagtactccgaatggctatcacgccttattatttgagtttgatagaccccgagaatcctaatgatccgattcgtaaacaagccactcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccagtgtggctgaacactcacttcaaccacccgaatgaagttaccgaagaagcagtggaggcttgtgaaagaatggccaatgccggtattccgttgggtaaccaaacggttttattgcgtggaatcaatgattgtacacgtgtgatgaagagattggtacatttgctggtaaagattcgtgtgcgtccttactacatatatgcttgcgatctttcgcttggaataagccatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggatgactatcatgaggagtgcgattgtgaggactgccgagtcgacaagcatcgtattggcgtggctgcactttccagcggtcagcagttggctttagagcctcccgacttagctcgcatggaacgcaggagcgataagaactaa

SEQ ID NO: 5046 - protein, 416 aa, Artificial Sequence
  Description of Artificial Sequence: Synthetic Construct
MAESRRKHYFPDVTDEQWYDWHWQVINRIKTLDTLEKYVTLTAEEEEGVKESPKVLRMAITPYYLSLIDPENPNDPIRKQATPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTRVMKRLVHLLVKIRVRPYYIYACDLSLGISHFRTPVSKGIEIIENLRGHTSGYAVPTFVVHAPGGGGKIPVAPNYVVSQSPRHVVLRNYEGVITTYTEPDDYHEECDCEDCRVDKHRIGVAALSSGQQLALEPPDLARMERRSDKN

SEQ ID NO: 5047 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattcgtacgctcgacacgctggagaagtacgttacactcaccgctgaagaagaagagggagtaaaagaatcgcccaaagtactccgaatggctatcacgccttattatttgagtttgatagaccccgagaatcctaatgatccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagtgcctcccgacttagctcgcatggaacgcaggagcgataagaactaa

SEQ ID NO: 5048 - protein, 416 aa, Artificial Sequence
  Description of Artificial Sequence: Synthetic Construct
MAESRRKHYFPDVTDEQWYDWHWQVINRIRTLDTLEKYVTLTAEEEEGVKESPKVLRMAITPYYLSLIDPENPNDPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALVPPDLARMERRSDKN

SEQ ID NO: 5049 - DNA, 1251 bp, Artificial Sequence
  Description of Artificial Sequence: Synthetic Construct
atggcagaaagtcgtagaaagcattatttccctgatgtcaccgatgagcaatggtacgactggcgttggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattattcgtataggaagccgtgcgccggtagtcctccctcagcgtataacgcctcaattggtggatatgctcaaaaaatatcatccggtgtgggtcaacactcacttcaaccacccgaatgaaatcaccgaagaagcagtggaggcttgtgaaatgctggccaatgccggtattccgttgggtaaccaaacggttttattgcgtggaatcaatgattgtacacatgtgatgaagagattggtacatttgctggtaaacattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5050 - protein, 416 aa, Artificial Sequence
  Description of Artificial Sequence: Synthetic Construct
MAESRRKHYFPDVTDEQWYDWRWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIIRIGSRAPVVLPQRITPQLVDMLKKYHPVWVNTHFNHPNEITEEAVEACEMLANAGIPLGNQTVLLRGINDCTHVMKRLVHLLVNIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5051 - DNA, 1251 bp, Artificial Sequence
  Description of Artificial Sequence: Synthetic Construct
atggcagttagtcgtagaaagcattatttccctgatgtcaccgatgagcaatagtacgactggcggtggcaggtcatcaatcgaattaaaacgctcgacctgctggagaagtacgttacactcaccgttgaagaagaagagggagtaaaagaatcgcccaaagtactccgagtggctatcacgccttattatttgagtttgatagaccccgagaatcctaattgtccgatttgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcctcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacatatatgcttgcgatctttcgcttggaataagccatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaatttcgaaggtgttatcacaacctatacggagccggatgactatcatgaggagtgcgattgtgaggactgccgagtcgacaagcatcgtgagggcgtggctgcactttccggaggtcagcagttggctttagtgcctcccgacttagctcgcaaagaacgcaggagcgataagaactaa

SEQ ID NO: 5052 - protein, 17 aa, Artificial Sequence
  Description of Artificial Sequence: Synthetic Construct
MAVSRRKHYFPDVTDEQ

SEQ ID NO: 5053 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaaaacgctcgacacgctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggaccgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacgtactgaagcgtctgcgcgaagtacctcatgtggagattgttcgtataggaagccgtgcgccggtagtcctccctcagcgtataacgcctcaattggtggatatgctcaaaaaatatcatccggtgtggctgaacgctcacttcaaccacccgaatgaagttaccgaagaagcagtggaggcttgtgaaagaatggccaatgccggtattccgttgggtaaccaaacggttttattgcgtggaatcaatgattgtacacgtgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaatttcgaaggtgttatcacaacctatacggagccggatgactatcatgaggagtgcgattgtgaggactgccgagtcgacaagcatcgtgagggcgtggctgcactttccagcggtcagcagttggctttagtgcctcccgacttagctcgcaaggaacgcaggagcgataagaactaa

SEQ ID NO: 5054 - protein, 416 aa, Artificial Sequence
  Description of Artificial Sequence: Synthetic Construct
MAESRRKHYFPDVTDEQWYDWHWQVINRIKTLDTLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYVLKRLREVPHVEIVRIGSRAPVVLPQRITPQLVDMLKKYHPVWLNAHFNHPNEVTEEAVEACERMANAGIPLGNQTVLLRGINDCTRVMKRLVHLLVKIRVRPYYIYACDLSLGIGHFRTPVSKGIEIIENLRGHTSGYAVPTFVVHAPGGGGKIPVAPNYVVSQSPRHVVLRNFEGVITTYTEPDDYHEECDCEDCRVDKHREGVAALSSGQQLALVPPDLARKERRSDKN

SEQ ID NO: 5055 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgcactccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacgtgtgatgaagagattggtacatttgctggtaaagattcgtgtgcgtccttactacatatatgcctgcgatctttcgcttggaataagccatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtattggcgtggctgcactttccagcggtcagcagttggctttagtgcctcccgacttagctcgcaaggaacgcaggagcgataagaactaa

SEQ ID NO: 5056 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTRVMKRLVHLLVKIRVRPYYIYACDLSLGISHFRTPVSKGIEIIENLRGHTSGYAVPTFVVHAPGGGGKIPVAPNYVVSQSPRHVVLRNYEGVITTYTEPEDYHEECDCEDCRVDKHRIGVAALSSGQQLALVPPDLARKERRSDKN

SEQ ID NO: 5057 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattattcgtataggaagccgtgcgccggtagtcctccctcagcgtataacgcctcaattggtggatatgctcaaaaaatatcatccggtgtgggtcaacactcacttcaaccacccgaatgaaatcaccgaagaagcagtggaggcttgtgaaaagatggccaatgccggtattccgttgggtaaccaaacggttttattgcgtggaatcaatgattgtacacatgtgatgaagagattggtacatttgctggtaaacatttgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5058 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIIRIGSRAPVVLPQRITPQLVDMLKKYHPVWVNTHFNHPNEITEEAVEACEKMANAGIPLGNQTVLLRGINDCTHVMKRLVHLLVNICVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5059 - DNA, 1251 bp, Artificial Sequence
  Description of Artificial Sequence: Synthetic Construct
atggcacaatgtcgtagatagcattatttacctgatgtcaccgatgagcaatcatacgactggcattggcatgtcatcaatcgaaataagacgctcgaccagctggagaagtacgttacactcaccgttgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcaacgacgaacgcttggaatacatactgaagcgtctgcgcgaagtacctcatgtggagattattcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaacgtatggccaatgccggtattccgttgggtaaccaaacggttttattgcgtggaatcaatgattgtacacatgtgatgaagagattggtacatttgctggtaaacattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5060 - protein, 6 aa, Artificial Sequence
  Description of Artificial Sequence: Synthetic Construct
MAQCRR

SEQ ID NO: 5061 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacgccttattatttgagtttgatagaccccgagaatcctaatgatccgattcgtaaacaagccattcctactaaacgggaactggtacgtgctcctgaagatatggtagacccacttagtgaagatgaagattcgcccgtacccggactgactcatcgttatccggatcgtgtattgttccttatcccggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgagtgaagttaccgaagaagcagtggaggcttgtgaaagaatggccaatgccggtattccgttgggtaaccaaacggttttattgcgtggaatcaatgattgtacacgtgtgatgaagagattggtacatttgctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaatttcgaaggtgttatcacaacctatacggagccggaggactatcatgaggagtgcgattgtgaggactgccgagtcgacaagcatcgtgagggcgtggctgcactttccagcggtcagcagttggctttagtgcctcccgacttagctcgcatggaacgcaggagcgataagaactaa

SEQ ID NO: 5062 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNDPIRKQAIPTKRELVRAPEDMVDPLSEDEDSPVPGLTHRYPDRVLFLIPDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPSEVTEEAVEACERMANAGIPLGNQTVLLRGINDCTRVMKRLVHLLVKIRVRPYYIYACDLSLGIGHFRTPVSKGIEIIENLRGHTSGYAVPTFVVHAPGGGGKIPVAPNYVVSQSPRHVVLRNFEGVITTYTEPEDYHEECDCEDCRVDKHREGVAALSSGQQLALVPPDLARMERRSDKN

SEQ ID NO: 5063 - DNA, 1251 bp, Artificial Sequence
  Description of Artificial Sequence: Synthetic Construct
atgacagaatgtcgtagatagcgttatttccctgatgtcaccgatgagcaatcatacgactggcattggcaggacctcaatcgaattaagaccctcgaccagctggagaagtacgttacactcaccgctgaagaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggaccgtgtattgttccttatcacggacaaatgttcgatgtactgtcgtcattgtactcgctgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagtcgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactacctgtatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5064 - protein, 6 aa, Artificial Sequence
  Description of Artificial Sequence: Synthetic Construct
MTECRR

SEQ ID NO: 5065 - DNA, 1251 bp, Artificial Sequence
  Description of Artificial Sequence: Synthetic Construct
ttggccgaaagtcgtagaaagcattatatccctgatgtcaccgatgagcaatcatacgactggcatgggcatgtcatcaatcgaattaagactctcgaccatctggagaagtacgtcacagtcaccgttgaagaagaagagggagtaaaagaatcgcccaaagtactccgaatggctatcacgccttattatttgagtttgatagaccccgagaatcctaattgtccgatttgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcgggacagagagatgcttcttctccttctgagcgcatcgatcgatgcattgagtatatagccaatacaccgacagtccgcgatgttttgctatcgggaggcgatgccctccttgtcagcgacgaacgcttggaatacatactgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagcgcttggtacataagctggtaaagattcgtgtgcgtccttactacatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttatctctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5066 - protein, 416 aa, Artificial Sequence
  Description of Artificial Sequence: Synthetic Construct
LAESRRKHYIPDVTDEQSYDWHGHVINRIKTLDHLEKYVTVTVEEEEGVKESPKVLRMAITPYYLSLIDPENPNCPICKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHKLVKIRVRPYYIYACDLSLGIGHFRTPVSKGIEIIENLRGHTSGYAVPTFVVHAPGGGGKIPVAPNYVISQSPRHVVLRNYEGVITTYTEPEDYHEECDCEDCRVDKHREGVAALSGGQQLALEPPDLARKERRSDKN

SEQ ID NO: 5067 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctatgtggtccatgctccggggggtggtggtaagatacctctggcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5068 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTYVVHAPGGGGKIPLAPNYVVSQSPRHVVLRNYEGVITTYTEPEDYHEECDCEDCRVDKHREGVAALSGGQQLALEPPDLARKERRSDKN

SEQ ID NO: 5069 - DNA, 1251 bp, Artificial Sequence
  Description of Artificial Sequence: Synthetic Construct
atggcagaaagtcgtagagagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggccttagagcctcccgacttagctcgcaaagaacgcaggagcgataagaactaa

SEQ ID NO: 5070 - protein, 416 aa, Artificial Sequence
  Description of Artificial Sequence: Synthetic Construct
MAESRREHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5071 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggaatcactcatcgttatccggatcgtgtattgctccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgagcactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactgtcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5072 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGITHRYPDRVLLLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLSTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDCHEECDCEDCRVDKHREGVAALSGGQQLALEPPDLARKERRSDKN

SEQ ID NO: 5073 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacaattcgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattgtgcgatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5074 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTIRDVLLSGGDALLVSDERLEYILKRLREVPHVEIVRIGSRAPVVLPQRITPQLCDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5075 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaaatccctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5076 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREIPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5077 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacaattcgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgtcatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5078 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTIRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5079 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggaatcactcatcgttatccggatcgtgtattgttgcttattacggacaaatgttcgatgtactgtcgtcattgtactcgccgtcgcttcgcaggacagagagatgcttcttctccttctgagcgcatcgatcgatgcattgagtatatagccaatacaccgacaattcgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaacaccatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaaccaatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5080 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGITHRYPDRVLLLITDKCSMYCRHCTRRRFAGQRDASSPSERIDRCIEYIANTPTIRDVLLSGGDALLVSDERLEYILKRLREVPHVEIVRIGSRAPVVLPQRITPQLVDMLKKHHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTNTEPEDYHEECDCEDCRVDKHREGVAALSGGQQLALEPPDLARKERRSDKN

SEQ ID NO: 5081 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacaattcgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaacaccatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5082 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTIRDVLLSGGDALLVSDERLEYILKRLREVPHVEIVRIGSRAPVVLPQRITPQLVDMLKKHHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5083 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaaccggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcggtgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatggagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5084 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKREPVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMERLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5085 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggaatcactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacaattcgcgatgttttgctatcgggaggcgatgccctccttgtcagcgacgaacgcttggaatacatattgaagcgtctgcgcgaaatccctcatgtggagattgttcgcataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5086 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGITHRYPDRVLFLITDKCSMYCRHCTRRRFAGQRDASSPSERIDRCIEYIANTPTIRDVLLSGGDALLVSDERLEYILKRLREIPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5087 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttgcttattacggacaaatgttcgatgtactgtcgtcattgtactcgccgtcgcttcgcaggacagagagatgcttcttctccttctgagcgcatcgatcgatgcattgagtatatagccaatacaccgacaattcgcgatgttttgctatcgggaggcgatgccctccttgtcagcgacgaacgcttggaatacatattgaagcgtctgcgcgaaatccctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgcgaggactgccgagtcgacaagcatcgtgagggcgtggctgcactttccggaggtcagcagttggctttagagcctcccgacttagctcgcaaagaacgcaggagcgataagaactaa

SEQ ID NO: 5088 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLLLITDKCSMYCRHCTRRRFAGQRDASSPSERIDRCIEYIANTPTIRDVLLSGGDALLVSDERLEYILKRLREIPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5089 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaaatactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5090 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKILRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5091 - DNA, 1251 bp, Artificial Sequence
  Description of Artificial Sequence: Synthetic Construct
atggcagaaagtcgtagaaagcattattggcctgctgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcaattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5092 - protein, 416 aa, Artificial Sequence
  Description of Artificial Sequence: Synthetic Construct
MAESRRKHYWPAVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECNCEDCRVDKHREGVAALSGGQQLALEPPDLARKERRSDKN

SEQ ID NO: 5093 - DNA, 1251 bp, Artificial Sequence
  Description of Artificial Sequence: Synthetic Construct
atggcagaaagtcgtagaaagcattattggcctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgtccgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5094 - protein, 416 aa, Artificial Sequence
  Description of Artificial Sequence: Synthetic Construct
MAESRRKHYWPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5095 - DNA, 1251 bp, Artificial Sequence
  Description of Artificial Sequence: Synthetic Construct
atggcagaaagtcgtagaaagcattattggcctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacgaatgttcgatgtactgtcgccattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5096 - protein, 416 aa, Artificial Sequence
  Description of Artificial Sequence: Synthetic Construct
MAESRRKHYWPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDECSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5097 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggaatcaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgctatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagtgattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5098 - protein, 274 aa, Artificial Sequence
  Description of Artificial Sequence: Synthetic Construct
MAESRRKHYFPDVTDEQWYDWHWQVINRIKTLDQLEKYVTLTAEEEEGIKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMK

SEQ ID NO: 5099 - DNA, 1251 bp, Artificial Sequence
  Description of Artificial Sequence: Synthetic Construct
atggcagaaagtcgtagaaagcattattggcctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaaccctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgcagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5100 - protein, 416 aa, Artificial Sequence
  Description of Artificial Sequence: Synthetic Construct
MAESRRKHYWPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPAAPNYVVSQSPRHVVLRNYEGVITTYTEPEDYHEECDCEDCRVDKHREGVAALSGGQQLALEPPDLARKERRSDKN

SEQ ID NO: 5101 - DNA, 1251 bp, Artificial Sequence
  Description of Artificial Sequence: Synthetic Construct
atggcagaaagtcgtagaaagcattattggcctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgggaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtacacgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacgtgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5102 - protein, 416 aa, Artificial Sequence
  Description of Artificial Sequence: Synthetic Construct
MAESRRKHYWPDVTDEQWYDWHWQVINRIKTLDQLEKYVTLTAEEEEGVKESPKVLRMAITPYYLSLIDPGNPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTRVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5103 - DNA, 1251 bp, Artificial Sequence
  Description of Artificial Sequence: Synthetic Construct
atggcagaaagtcgtagaaagcattattggcctgctgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5104 - protein, 416 aa, Artificial Sequence
  Description of Artificial Sequence: Synthetic Construct
MAESRRKHYWPAVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5105 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgggggcgtggctgcactttccggaggtcagcagttggctttagagcctcccgacttagctcgcaaagaacgcaggagcgataagaactaa

SEQ ID NO: 5106 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHRGGVAALSGGQQLALEPPDLARKERRSDKN

SEQ ID NO: 5107 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagtcgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5108 - protein, 416 aa, Artificial Sequence; identical to SEQ ID NO: 3260
  Description of Artificial Sequence: Synthetic Construct

SEQ ID NO: 5109 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaactcgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5110 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGTRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5111 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagtcgtacaccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5112 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5113 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaggacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggctcgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5114 - protein, 416 aa, Artificial Sequence
  Description of Artificial Sequence: Synthetic Construct
MAESRRKHYFPDVTDEQWYDWHWQVINRIRTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEARERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5115 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggcttcgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5116 - protein, 416 aa, Artificial Sequence; identical to SEQ ID NO: 4834
  Description of Artificial Sequence: Synthetic Construct

SEQ ID NO: 5117 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagtcgtacaccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactgtgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5118 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNCVVSQSPRHVVLRNYEGVITTYTEPEDYHEECDCEDCRVDKHREGVAALSGGQQLALEPPDLARKERRSDKN

SEQ ID NO: 5119 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagtcgtacaccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatttagtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5120 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRTPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYLVSQSPRHVVLRNYEGVITTYTEPEDYHEECDCEDCRVDKHREGVAALSGGQQLALEPPDLARKERRSDKN

SEQ ID NO: 5121 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacacccacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtccatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttggctcgcaaagaacgcaggagcgataagaaccaa

SEQ ID NO: 5122 - protein, 417 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKNQ

SEQ ID NO: 5123 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgccggtaaagattcgtgtgcgtccttactatatatatgcttgcgatctttcgcttggaatagggcatttccgcacgccggtatctaagggaatcgaaattatcgaaaatttgcgcggacacacctcgggcttcgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5124 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLPVKIRVRPYYIYACDLSLGIGHFRTPVSKGIEIIENLRGHTSGFAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5125 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaaggttcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtcgctgcactttcaggaggtcagcagttggctttagagcctcccgacttagctcgcaaagaacgcaggagcgataagaactaa

SEQ ID NO: 5126 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEGSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5127 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcgtcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagaaattggtacatctgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttatctctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcgcgacttagaacgcaaagaacgcaggagcgataagaactaa

SEQ ID NO: 5128 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTRRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKKLVHLLVKIRVRPYYIYACDLSLGIGHFRTPVSKGIEIIENLRGHTSGYAVPTFVVHAPGGGGKIPVAPNYVISQSPRHVVLRNYEGVITTYTEPEDYHEECDCEDCRVDKHREGVAALSGGQQLALEPRDLERKERRSDKN

SEQ ID NO: 5129 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcatcgctgcactttcaggaggtcagcagttggctttagagcctcccgacttagctcgcaaagaacgcaggagcgataagaactaa

SEQ ID NO: 5130 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGIAALSGGQQLALEPPDLARKERRSDKN

SEQ ID NO: 5131 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagcgcttggtacatctgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattacgaaggtgttatcacaacctatacggagccggaggactatcatgaggagtgcgattgtgaggactgccgagtcgacaagcatcgtgagggcgtggctgcactttccggaggtcggcagttggctttagagcctcccgacttagaacgcaaagaacgcaggagcgataagaactaa

SEQ ID NO: 5132 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGRQLALEPPDLERKERRSDKN

SEQ ID NO: 5133 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgcggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacataagctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5134 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHAEIVRIGSRAPVVLPQRITPQLVDMLKKYHPVWLNTHFNHPNEVTEEAVEACERMANAGIPLGNQTVLLRGINDCTHVMKRLVHKLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5135 - DNA, 1251 bp, Artificial Sequence
  Description of Artificial Sequence: Synthetic Construct
atggcagaaagtcgtagaaagcattatttccccgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcaatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgcataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgagagggcgtggctgcactttccggaggtcagcagttggctttagagcctcccgacttagctcgcaaagaacgcaggagcgataagaactaa

SEQ ID NO: 5136 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERINRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5137 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatgctgagggcatcgctgcacttttaggaggtcagcagttggctttagagcctcccgacttagaacgcaaagaacgcaggagcgataagaactaa

SEQ ID NO: 5138 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHAEGIAALLGGQQLALEPPDLERKERRSDKN

SEQ ID NO: 5139 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagaaattggtacataagctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5140 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKKLVHKLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5141 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccatccctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5142 - protein, 416 aa, Artificial Sequence; identical to SEQ ID NO: 3260
  Description of Artificial Sequence: Synthetic Construct

SEQ ID NO: 5143 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacaattcgcgatgttttgctatcgggaggcgatgccctccttgtcagcgacgaacgcttggaatacatattgaagcgtctgcgcgaaatccctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5144 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTIRDVLLSGGDALLVSDERLEYILKRLREIPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5145 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgatttgtaaacaagccattcctactaaacgggaactggtacgtgctcctgaagatatggtagacccacttagtgaagatgaagattcgcccgtacccggactgactcatcgttatccggatcgtgtattgttccttgtcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5146 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPICKQAIPTKRELVRAPEDMVDPLSEDEDSPVPGLTHRYPDRVLFLVTDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5147 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggaatcactcatcgttatccggatcgtgtattgttccttatcacggacagatgttcgatgtactgtcgtcattgtactcgccgtcgcttcgcaggacagagagatgcttcttctccttctgagcgcatcgatcgatgcattgagtatatagccaatacaccgacaattcgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctacgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5148 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGITHRYPDRVLFLITDRCSMYCRHCTRRRFAGQRDASSPSERIDRCIEYIANTPTIRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5149 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttgcttattacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaaatccctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5150 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLLLITDKCSMYCRHCTRRRFAGQRDASSPSERIDRCIEYIANTPTVRDVLLSGGDALLVSDERLEYILKRLREIPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5151 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgctatccggatcgtgtattgttgcttgttacggacaaatgttcgatgtactgtcgtcattgtactcgccgtcgcttcgcgggacagagagatgcttcttctccttctgagcgcatcgatcgatgcattgagtatatagccaatacaccgacaattcgcgatgttttgctatcgggaggcgatgccctccttgtcagcgacgaacgcttggaatacatattgaagcgtctgcgcgaaatccctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagctgtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgtggactgccgagtcgacaagcatcgtgagggcgtggctgcactttccggaggtcagcagttggctttagagcctcccgacttagctcgcaaagaacgcaggagcgataagaactaa

SEQ ID NO: 5152 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLLLVTDKCSMYCRHCTRRRFAGQRDASSPSERIDRCIEYIANTPTIRDVLLSGGDALLVSDERLEYILKRLREIPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCVDCRVDKHREGVAALSGGQQLALEPPDLARKERRSDKN

SEQ ID NO: 5153 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggaatcactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacaattcgcgatgttttgctatcgggaggcgatgccctccttctgagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5154 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGITHRYPDRVLFLITDKCSMYCRHCTRRRFAGQRDASSPSERIDRCIEYIANTPTIRDVLLSGGDALLLSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5155 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgctccttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaaatccctcatgtggagattgttcgtataggaagccgtgcgccggtagtcctccctcagcgtataacgcctcaattggtggatatgctcaaaaaacaccatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5156 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDAPSPSERIDRCIEYIANTPTVRDVLLSGGDALLVSDERLEYILKRLREIPHVEIVRIGSRAPVVLPQRITPQLVDMLKKHHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5157 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacaattcgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctaccttcgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5158 - protein, 416 aa, Artificial Sequence; identical to SEQ ID NO: 5078
  Description of Artificial Sequence: Synthetic Construct

SEQ ID NO: 5159 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagatcgttcgtataggaagccgtgcgccggtagtcctccctcagcgtataacgcctcaattggtggatatgctcaaaaaatatcatccggtgtggctgaacacccacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5160 - protein, 416 aa, Artificial Sequence; identical to SEQ ID NO: 3260
  Description of Artificial Sequence: Synthetic Construct

SEQ ID NO: 5161 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccacgagaatcctaattgtccgattcgtaaacaagccattcctactaaacgggaactggtacgtgctcctgaagatatggtagacccacttagtgaagatgaagattcgcccgtacccggaatcactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacaattcgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5162 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDHENPNCPIRKQAIPTKRELVRAPEDMVDPLSEDEDSPVPGITHRYPDRVLFLITDKCSMYCRHCTRRRFAGQRDASSPSERIDRCIEYIANTPTIRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5163 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggcgattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5164 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVAIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5165 - DNA, 1251 bp, Artificial Sequence
  Description of Artificial Sequence: Synthetic Construct
atggcagaaagtcgtagaaagcattatttccctgatgtcaccgatgagcaatggtacgactggcactggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgatccgtaaacaagccattcctactaaacgggaactggtacgtgctcctgaagatatggtagacccacttagtgaagatgaagattcgcccgtacccggaatcactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggtgtggctgcactttccggaggtcagcagttggctttagagcctcccgacttagctcgcaaagaacgtaggagcgataagatctaa

SEQ ID NO: 5166 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGITHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKI

SEQ ID NO: 5167 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttgcttgttacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5168 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLLLVTDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5169 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggaatcactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacaattcgcgatgttttgctatcgggaggcgatgccctccttgtcagcgacgaacgcttggaatacatattgaagcgtctgcgcgaaatccctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgtcatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5170 - protein, 416 aa, Artificial Sequence; identical to SEQ ID NO: 5086
  Description of Artificial Sequence: Synthetic Construct

SEQ ID NO: 5171 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccgaatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttctgagcgacgaacgcttggaatacatattgaagcgtctgcgcgaaatccctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5172 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPNRVLFLITDKCSMYCRHCTRRRFAGQRDASSPSERIDRCIEYIANTPTVRDVLLSGGDALLLSDERLEYILKRLREIPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5173 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccatccctactaaacgggaactggtacgtgctcctgaagatatggtagacccacttagtgaagatgaagattcgcccgtacccggaatcactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaaatccctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5174 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGITHRYPDRVLFLITDKCSMYCRHCTRRRFAGQRDASSPSERIDRCIEYIANTPTVRDVLLSGGDALLVSDERLEYILKRLREIPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5175 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacacccacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5176 - protein, 416 aa, Artificial Sequence; identical to SEQ ID NO: 3260
  Description of Artificial Sequence: Synthetic Construct

SEQ ID NO: 5177 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggaatcactcatcgttatccggatcgtgtattgttccttgttacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5178 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGITHRYPDRVLFLVTDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5179 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggaatcactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacaattcgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5180 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGITHRYPDRVLFLITDKCSMYCRHCTRRRFAGQRDASSPSERIDRCIEYIANTPTIRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5181 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggaatcactcatcgttatccggatcgtgtattgtttcttattacggacaaatgttcgatgtactgtcgtcattgtactcgccgtcgcttcgcaggacagagagatgcttcttctccttctgagcgcatcgatcgatgcattgagtatatagccaatacaccgacaattcgcgatgttttgctatcgggaggcgatgccctccttctgagcgacgaacgcttggaatacatattgaagcgtctgcgcgaaatccctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatgtatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5182 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGITHRYPDRVLFLITDKCSMYCRHCTRRRFAGQRDASSPSERIDRCIEYIANTPTIRDVLLSGGDALLLSDERLEYILKRLREIPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYMYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5183 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaacaccatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5184 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKHHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5185 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggaatcactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5186 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGITHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5187 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggcggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5188 - protein, 416 aa, Artificial Sequence; identical to SEQ ID NO: 3260
  Description of Artificial Sequence: Synthetic Construct

SEQ ID NO: 5189 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggaatcactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacacgctccggggggtggtggtaagatacctgtagcgccgaactatgttgtatctcagtccccacgacatgtggttcttcgcaattatgaaggtgttatcacaacctatacggagccggaggactatcatggggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5190 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGITHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHGECDCEDCRVDKHREGVAALSGGQQLALEPPDLARKERRSDKN

SEQ ID NO: 5191 - DNA, 1251 bp, Artificial Sequence
  Description of Artificial Sequence: Synthetic Construct
atggcagaaagtcgtagaaagcattattggcctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccgtgcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5192 - protein, 416 aa, Artificial Sequence
  Description of Artificial Sequence: Synthetic Construct
MAESRRKHYWPDVTDEQWYDWHWQVINRIKTLDQLEKYVTLTAEEEEGVKESPKVLRMAITPYYLSLIDPENPNCPIRKQAVPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5193 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggaccgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5194 - protein, 416 aa, Artificial Sequence; identical to SEQ ID NO: 3260
  Description of Artificial Sequence: Synthetic Construct

SEQ ID NO: 5195 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccggtgcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5196 - protein, 416 aa, Artificial Sequence; identical to SEQ ID NO: 3728
  Description of Artificial Sequence: Synthetic Construct

SEQ ID NO: 5197 - DNA, 1251 bp, Artificial Sequence
  Description of Artificial Sequence: Synthetic Construct
atggcagaaagtcgtagaaagcattattggcctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5198 - protein, 416 aa, Artificial Sequence; identical to SEQ ID NO: 5094
  Description of Artificial Sequence: Synthetic Construct

SEQ ID NO: 5199 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtatgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatgcggagccggaggactatcatggggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5200 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYAEPEDYHGECDCEDCRVDKHREGVAALSGGQQLALEPPDLARKERRSDKN

SEQ ID NO: 5201 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccgtgcctactaaacgggaactggtacatgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5202 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAVPTKRELVHAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5203 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggccttagagcctcccgacttagctcgcaaagaacgcaggagcgataagaactaa

SEQ ID NO: 5204 - protein, 416 aa, Artificial Sequence; identical to SEQ ID NO: 3260
  Description of Artificial Sequence: Synthetic Construct

SEQ ID NO: 5205 - DNA, 1251 bp, Artificial Sequence
  Description of Artificial Sequence: Synthetic Construct
atggcagaaagtcgtagaaagcattattggcctgatgtcaccgatgagcaatggtacgactggcattggcaggtcatcaatcgaattaagacgctcgaccagctggagaagtacgttacactcaccgctgaagaagaagagggaatcaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5206 - protein, 416 aa, Artificial Sequence
  Description of Artificial Sequence: Synthetic Construct
MAESRRKHYWPDVTDEQWYDWHWQVINRIKTLDQLEKYVTLTAEEEEGIKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5207 - DNA, 1251 bp, Artificial Sequence
  Description of Artificial Sequence: Synthetic Construct
atggcagaaagtcgtagaaagcattattggcctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccccgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5208 - protein, 416 aa, Artificial Sequence; identical to SEQ ID NO: 5094
  Description of Artificial Sequence: Synthetic Construct

SEQ ID NO: 5209 - DNA, 1251 bp, Artificial Sequence
  Description of Artificial Sequence: Synthetic Construct
atggcagaaagtcgtagaaagcattatttccctgctgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5210 - protein, 416 aa, Artificial Sequence
  Description of Artificial Sequence: Synthetic Construct
MAESRRKHYFPAVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5211 - DNA, 1251 bp, Artificial Sequence
  Description of Artificial Sequence: Synthetic Construct
atggcagaaagtcgtagaaagcattattggcctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcactgacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5212 - protein, 416 aa, Artificial Sequence; identical to SEQ ID NO: 5094
  Description of Artificial Sequence: Synthetic Construct

SEQ ID NO: 5213 - DNA, 1251 bp, Artificial Sequence
  Description of Artificial Sequence: Synthetic Construct
atggcagaaagtcgtagaaagcattattggcctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcgtttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5214 - protein, 416 aa, Artificial Sequence
  Description of Artificial Sequence: Synthetic Construct
MAESRRKHYWPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGRFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5215 - DNA, 1251 bp, Artificial Sequence
  Description of Artificial Sequence: Synthetic Construct
atggcagaaagtcgtagaaagcattattggcctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaacgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5216 - protein, 416 aa, Artificial Sequence; identical to SEQ ID NO: 5094
  Description of Artificial Sequence: Synthetic Construct

SEQ ID NO: 5217 - DNA, 1251 bp, Artificial Sequence
  Description of Artificial Sequence: Synthetic Construct
atggcagaaagtcgtagaaagcattatttccctgaggtcaccgatgagcaatggtacgactggcattggcaggtcatcaatcgaattaagacgctcgaccagctggagaagtacgttacactcaccgctgaagaagaagagggaatcaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5218 - protein, 416 aa, Artificial Sequence
  Description of Artificial Sequence: Synthetic Construct
MAESRRKHYFPEVTDEQWYDWHWQVINRIKTLDQLEKYVTLTAEEEEGIKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5219 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccgtgcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgccccaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5220 - protein, 416 aa, Artificial Sequence; identical to SEQ ID NO: 4764
  Description of Artificial Sequence: Synthetic Construct

SEQ ID NO: 5221 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgacctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5222 - protein, 416 aa, Artificial Sequence; identical to SEQ ID NO: 3260
  Description of Artificial Sequence: Synthetic Construct

SEQ ID NO: 5223 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacggtggaccagttagagaagtacgtcacaattaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgcgaggactgccgagtcgacaagcatcgtgagggcgtggctgcactttccggaggtcagcagttggctttagagcctcccgacttagctcgcaaagaacgcaggagcgataagaactaa

SEQ ID NO: 5224 - protein, 416 aa, Artificial Sequence
  Description of Artificial Sequence: Synthetic Construct
MAESRRKHYFPDVTDEQWYDWHWQVINRIKTVDQLEKYVTITAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5225 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgagcgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtgcatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5226 - protein, 416 aa, Artificial Sequence; identical to SEQ ID NO: 3260
  Description of Artificial Sequence: Synthetic Construct

SEQ ID NO: 5227 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaagtttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5228 - protein, 416 aa, Artificial Sequence; identical to SEQ ID NO: 4036
  Description of Artificial Sequence: Synthetic Construct

SEQ ID NO: 5229 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggggattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccgcgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5230 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVGIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5231 - DNA, 1251 bp, Artificial Sequence
  Description of Artificial Sequence: Synthetic Construct
atggcagaaagtcgtagaaagcattattggcctgctgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcaataagaactaa

SEQ ID NO: 5232 - protein, 416 aa, Artificial Sequence
  Description of Artificial Sequence: Synthetic Construct
MAESRRKHYWPAVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSNKN

SEQ ID NO: 5233 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccgggggtcagcagttggctttagagcctcccgacttagctcgcaaagaacgcaggagcgataagaactaa

SEQ ID NO: 5234 - protein, 416 aa, Artificial Sequence; identical to SEQ ID NO: 3260
  Description of Artificial Sequence: Synthetic Construct

SEQ ID NO: 5235 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccgtgcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5236 - protein, 416 aa, Artificial Sequence; identical to SEQ ID NO: 4764
  Description of Artificial Sequence: Synthetic Construct

SEQ ID NO: 5237 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagcccgcaaagaacgcaggagcgataagaactaa

SEQ ID NO: 5238 - protein, 416 aa, Artificial Sequence; identical to SEQ ID NO: 3260
  Description of Artificial Sequence: Synthetic Construct

SEQ ID NO: 5239 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggggcgataagaactaa

SEQ ID NO: 5240 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRGDKN

SEQ ID NO: 5241 - DNA, 1251 bp, Artificial Sequence
  Description of Artificial Sequence: Synthetic Construct
atgtcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccggtgcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5242 - protein, 416 aa, Artificial Sequence
  Description of Artificial Sequence: Synthetic Construct
MSESRRKHYFPDVTDEQWYDWHWQVINRIKTLDQLEKYVTLTAEEEEGVKESPKVLRMAITPYYLSLIDPENPNCPVRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5243 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgccgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgcctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5244 - protein, 416 aa, Artificial Sequence; identical to SEQ ID NO: 3260
  Description of Artificial Sequence: Synthetic Construct

SEQ ID NO: 5245 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagtcgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctttgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5246 - protein, 416 aa, Artificial Sequence; identical to SEQ ID NO: 4834
  Description of Artificial Sequence: Synthetic Construct

SEQ ID NO: 5247 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaactcgtgtgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacggcatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5248 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGTRVPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5249 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgcgaggactgccgagtcgacaagcatcgtgagggcgtggctgcactttccggaggtcagcagttggctttagagcctcccgacttagctcgcaaagaacgcaggagcgataagaactaa

SEQ ID NO: 5250 - protein, 416 aa, Artificial Sequence; identical to SEQ ID NO: 3260
  Description of Artificial Sequence: Synthetic Construct

SEQ ID NO: 5251 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggcttcgcagttcctacctatgtggtccatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5252 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGFAVPTYVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5253 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaactcgtgcgccggtagtcctccctcagcgtataacgcctcaattggtggatatgctcaaaaaatatcatccggtgtggctgaacactcacttcgaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5254 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGTRAPVVLPQRITPQLVDMLKKYHPVWLNTHFDHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5255 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtacaccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtccatgctccggggggtggtggtaagatacctgtagcgccgaactatgtcgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5256 - protein, 416 aa, Artificial Sequence; identical to SEQ ID NO: 5112
  Description of Artificial Sequence: Synthetic Construct

SEQ ID NO: 5257 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgacgttttgctatcgggaggcgatgccctccttgtcagcgacgaacgcttggaatacatattgaagcgtctgcgcgaagtacctcatgtggagattgttcgtataggaagtcgtgtgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggcttcgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5258 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRVPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGFAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5259 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccgttcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaactcgtgcgccggtagtcctccctcagcgtataacgcctcaattggtggatatgctcaaaaaatatcatccggtgtggctgaacactcacttcaaccacccgaatgaagttaccgaagaagcagcggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggcttcgcagttcctacctttgtggtccatgctccggggggtggtggtaagatacctgtagcgccgaactatttagtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5260 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAVPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGTRAPVVLPQRITPQLVDMLKKYHPVWLNTHFNHPNEVTEEAAEACERMANAGIPLGNQTVLLRGINDCTHVMKRLVHLLVKIRVRPYYIYACDLSLGIGHFRTPVSKGIEIIENLRGHTSGFAVPTFVVHAPGGGGKIPVAPNYLVSQSPRHVVLRNYEGVITTYTEPEDYHEECDCEDCRVDKHREGVAALSGGQQLALEPPDLARKERRSDKN

SEQ ID NO: 5261 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcactccaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5262 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHSNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5263 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagtcgtgtgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5264 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRVPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5265 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagtcgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatttagtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcaattggctttagagcctcccgacttagctcgcaaagaacgcaggagcgataagaactaa

SEQ ID NO: 5266 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYLVSQSPRHVVLRNYEGVITTYTEPEDYHEECDCEDCRVDKHREGVAALSGGQQLALEPPDLARKERRSDKN

SEQ ID NO: 5267 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaactcgtgtgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatttagtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5268 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGTRVPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYLVSQSPRHVVLRNYEGVITTYTEPEDYHEECDCEDCRVDKHREGVAALSGGQQLALEPPDLARKERRSDKN

SEQ ID NO: 5269 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagtcgtacaccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggcggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5270 - protein, 416 aa, Artificial Sequence; identical to SEQ ID NO: 5112
  Description of Artificial Sequence: Synthetic Construct

SEQ ID NO: 5271 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaactcgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctacgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5272 - protein, 416 aa, Artificial Sequence; identical to SEQ ID NO: 5110
  Description of Artificial Sequence: Synthetic Construct

SEQ ID NO: 5273 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggcagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtacctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5274 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPAVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVPKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5275 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgtttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggcttcgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5276 - protein, 416 aa, Artificial Sequence; identical to SEQ ID NO: 4834
  Description of Artificial Sequence: Synthetic Construct

SEQ ID NO: 5277 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcacatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagatggctttagagcctcccgacttagctcgcaaagaacgcaggagcgataagaactaa

SEQ ID NO: 5278 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSEHIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQMALEPPDLARKERRSDKN

SEQ ID NO: 5279 - DNA, 1251 bp, Artificial Sequence
  Description of Artificial Sequence: Synthetic Construct
atggcagaaagtcgtagaaagcattatttccctgatgtcaccgatgagcaatggtatgactggcattggcaggtcatcaatcgaattaagacgcccgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagtcgtgtgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatttagtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5280 - protein, 416 aa, Artificial Sequence
  Description of Artificial Sequence: Synthetic Construct
MAESRRKHYFPDVTDEQWYDWHWQVINRIKTPDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRVPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYLVSQSPRHVVLRNYEGVITTYTEPEDYHEECDCEDCRVDKHREGVAALSGGQQLALEPPDLARKERRSDKN

SEQ ID NO: 5281 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgggtatatagccaacacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggcttcgcagttcctacctatgtggtccatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgacaagaactaa

SEQ ID NO: 5282 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIGYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGFAVPTYVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5283 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatttagtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5284 - protein, 416 aa, Artificial Sequence; identical to SEQ ID NO: 5266
  Description of Artificial Sequence: Synthetic Construct

SEQ ID NO: 5285 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaggatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggcttcgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5286 - protein, 416 aa, Artificial Sequence; identical to SEQ ID NO: 4834
  Description of Artificial Sequence: Synthetic Construct

SEQ ID NO: 5287 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagtcgtgtgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggcttcgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5288 - protein, 416 aa, Artificial Sequence; identical to SEQ ID NO: 5258
  Description of Artificial Sequence: Synthetic Construct

SEQ ID NO: 5289 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgcataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttgactttagagcctcccgacttagctcgcaaagaacgcaggagcgataagaactaa

SEQ ID NO: 5290 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLTLEPPDLARKERRSDKN

SEQ ID NO: 5291 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagccgacaagcatcgtgagggcgtggctgcactttccggaggtcagcagttggctttagagcctcccgacttagctcgcaaagaacgcaggagcgataagaactaa

SEQ ID NO: 5292 - protein, 416 aa, Artificial Sequence; identical to SEQ ID NO: 3716
  Description of Artificial Sequence: Synthetic Construct

SEQ ID NO: 5293 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctatgtggtccatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccgggggtcagcagttggctttagagcctcccgacttagctcgcaaagaacgcaggagcgataagaactaa

SEQ ID NO: 5294 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTYVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5295 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagaaattggtacatctgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttcaggaggtcagcagttggctttagagcctcccgacttagctcgcaaagaacgcaggagcgataagaactaa

SEQ ID NO: 5296 - protein, 416 aa, Artificial Sequence; identical to SEQ ID NO: 4856
  Description of Artificial Sequence: Synthetic Construct

SEQ ID NO: 5297 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttatctctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcggtaagaactaa

SEQ ID NO: 5298 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVISQSPRHVVLRNYEGVITTYTEPEDYHEECDCEDCRVDKHREGVAALSGGQQLALEPPDLARKERRSGKN

SEQ ID NO: 5299 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacacctcattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatctgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5300 - protein, 416 aa, Artificial Sequence; identical to SEQ ID NO: 3890
  Description of Artificial Sequence: Synthetic Construct

SEQ ID NO: 5301 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgcccgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagcgcttggtacataagctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagaacgcaaagaacgcaggagcgataagaactaa

SEQ ID NO: 5302 - protein, 416 aa, Artificial Sequence
  Description of Artificial Sequence: Synthetic Construct
MAESRRKHYFPDVTDEQWYDWHWQVINRIKTPDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHKLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLERKERRSDKN

SEQ ID NO: 5303 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagaacgcaaagaacgcaggagcgataagaactaa

SEQ ID NO: 5304 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLERKERRSDKN

SEQ ID NO: 5305 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagagctaa

SEQ ID NO: 5306 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKS

SEQ ID NO: 5307 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcaccgtgagggcgtggctgcactttcaggaggtcagcagttggctttagagcctcccgacttagctcgcaaagaacgcaggagcgataagaactaa

SEQ ID NO: 5308 - protein, 416 aa, Artificial Sequence; identical to SEQ ID NO: 3260
  Description of Artificial Sequence: Synthetic Construct

SEQ ID NO: 5309 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcctgcgatctttcgcttggaatagggcatttccgcacgccggtatctaagggaatcgaaattatcgaaaatttgcgcggacacacctcgggctatgcagttcctacctttgtggcacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5310 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVAHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5311 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtaccacatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5312 - protein, 416 aa, Artificial Sequence; identical to SEQ ID NO: 3260
  Description of Artificial Sequence: Synthetic Construct

SEQ ID NO: 5313 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagcgcttggtacatctgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatgctgagggcgtcgctgcacttttaggaggtcagcagttggctttagagcctcccgacttagctcgcaaagaacgcaggagcgataagaactaa

SEQ ID NO: 5314 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHAEGVAALLGGQQLALEPPDLARKERRSDKN

SEQ ID NO: 5315 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcggtccccacgacatgtggtccttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5316 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSRSPRHVVLRNYEGVITTYTEPEDYHEECDCEDCRVDKHREGVAALSGGQQLALEPPDLARKERRSDKN

SEQ ID NO: 5317 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgtgcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtcgctgcactttcaggaggtcagcagttggctttagagcctcccgacttagctcgcaaagaacgcaggagcgataagaactaa

SEQ ID NO: 5318 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSVRIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5319 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcatcgctgcactttccggaggtcagcagttggctttagagcctcccgacttagctcgcaaagaacgcaggagcgataagaactaa

SEQ ID NO: 5320 - protein, 416 aa, Artificial Sequence; identical to SEQ ID NO: 5130
  Description of Artificial Sequence: Synthetic Construct

SEQ ID NO: 5321 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtccttcctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagcgcttggtacatctgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtcgctgcactttcaggaggtcagcagttggctttagagcctcccgacttagaacgcaaagaacgcaggagcgataagaactaa

SEQ ID NO: 5322 - protein, 416 aa, Artificial Sequence; identical to SEQ ID NO: 5304
  Description of Artificial Sequence: Synthetic Construct

SEQ ID NO: 5323 - DNA, 1251 bp, Artificial Sequence
  Description of Artificial Sequence: Synthetic Construct
atggcagaaagtcgtagacagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactggctcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5324 - protein, 416 aa, Artificial Sequence
  Description of Artificial Sequence: Synthetic Construct
MAESRRQHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLAHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5325 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttgggatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5326 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLGYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5327 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttaccacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgcataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagaaattggtacatctgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5328 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLTTDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKKLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5329 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatctgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcccacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagaacgcaaagaacgcaggagcgataagaactaa

SEQ ID NO: 5330 - protein, 416 aa, Artificial Sequence; identical to SEQ ID NO: 5304
  Description of Artificial Sequence: Synthetic Construct

SEQ ID NO: 5331 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatctgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtcgctgcacttttaggaggtcagcagttggctttagagcctcccgacttagctcgcgaagaacgcaggagcgataagaactaa

SEQ ID NO: 5332 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALLGGQQLALEPPDLAREERRSDKN

SEQ ID NO: 5333 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaggagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagaaattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5334 - protein, 416 aa, Artificial Sequence; identical to SEQ ID NO: 4856
  Description of Artificial Sequence: Synthetic Construct

SEQ ID NO: 5335 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggcgaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgctccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcacccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagaaattggtacataagctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttatctctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5336 - protein, 416 aa, Artificial Sequence
  Description of Artificial Sequence: Synthetic Construct
MAESRRKHYFPDVTDEQWYDWHWQVINRIKTLDQLAKYVTLTAEEEEGVKESPKVLRMAITPYYLSLIDPENPNCPIRKQAIPTKRELVRAPEDMVDPLSEDEDSPVPGLTHRYPDRVLLLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKKLVHKLVKIRVRPYYIYACDLSLGIGHFRTPVSKGIEIIENLRGHTSGYAVPTFVVHAPGGGGKIPVAPNYVISQSPRHVVLRNYEGVITTYTEPEDYHEECDCEDCRVDKHREGVAALSGGQQLALEPPDLARKERRSDKN

SEQ ID NO: 5337 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtgcctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5338 - protein, 416 aa, Artificial Sequence; identical to SEQ ID NO: 3260
  Description of Artificial Sequence: Synthetic Construct

SEQ ID NO: 5339 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatctgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagcgcttggtacatctgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttatctctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5340 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVISQSPRHVVLRNYEGVITTYTEPEDYHEECDCEDCRVDKHREGVAALSGGQQLALEPPDLARKERRSDKN

SEQ ID NO: 5341 - DNA, 1251 bp, Artificial Sequence
  Description of Artificial Sequence: Synthetic Construct
atggcagaaagtcgtagaaagcattatttccccgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatgctgagggcgtcgctgcactttcaggaggtcagcagttggctttagagcctcccgacttagctcgcaaagaacgcaggagcgataagaactaa

SEQ ID NO: 5342 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHAEGVAALSGGQQLALEPPDLARKERRSDKN

SEQ ID NO: 5343 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagcgcttggtacatctgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctacacggagccggaggactatcatgaggagtgcgattgcgaggactgccgagtcgacaagcatcgtgagggcgtggctgcactttccggaggtcagcagttggctttagagcctcccgacttagctcgcaaagaacgcaggagcgatgagaactaa

SEQ ID NO: 5344 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDEN

SEQ ID NO: 5345 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagcgcttggtacataagctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagccgacaagcatcgtgagggcgtcgctgcactttcaggaggtcagcagttggctttagagcctcccgacttagctcgcaaagaacgcaggagcgataagaactaa

SEQ ID NO: 5346 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHKLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRADKHREGVAALSGGQQLALEPPDLARKERRSDKN

SEQ ID NO: 5347 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatacttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagaaattggtacatctgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttatctctcagtccccacgacatgtggttcttcgcaattatgaaggtgttatcacaacctatacggagccggaggactatcatgaggagtgcgattgtgaggactgccgagtcgacaagcatcgtgagggcatcgctgcacttttaggaggtcagcagttggctttagagcctcccgacttagctcgcaaagaacgcaggagcgataagaactaa

SEQ ID NO: 5348 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDTSSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKKLVHLLVKIRVRPYYIYACDLSLGIGHFRTPVSKGIEIIENLRGHTSGYAVPTFVVHAPGGGGKIPVAPNYVISQSPRHVVLRNYEGVITTYTEPEDYHEECDCEDCRVDKHREGIAALLGGQQLALEPPDLARKERRSDKN

SEQ ID NO: 5349 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggaggagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagcgcttggtacatctgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggggcgataagaactaa

SEQ ID NO: 5350 - protein, 416 aa, Artificial Sequence
  Description of Artificial Sequence: Synthetic Construct
MAESRRKHYFPDVTDEQWYDWHWQVINRIKTLDQLEEYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRGDKN

SEQ ID NO: 5351 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagaaattggtacatctgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcacttttaggaggtcagcagttggctttagagcctcccgacttagctcgcaaagaacgcaggagcgataagaactaa

SEQ ID NO: 5352 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKKLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALLGGQQLALEPPDLARKERRSDKN

SEQ ID NO: 5353 - DNA, 1251 bp, Artificial Sequence
  Description of Artificial Sequence: Synthetic Construct
atggcagaaagtcgtagaaagcattatttccctgatgtcaccgatgagcaatggcacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagcgcttggtacataagctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttatctctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5354 - protein, 416 aa, Artificial Sequence
  Description of Artificial Sequence: Synthetic Construct
MAESRRKHYFPDVTDEQWHDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHKLVKIRVRPYYIYACDLSLGIGHFRTPVSKGIEIIENLRGHTSGYAVPTFVVHAPGGGGKIPVAPNYVISQSPRHVVLRNYEGVITTYTEPEDYHEECDCEDCRVDKHREGVAALSGGQQLALEPPDLARKERRSDKN

SEQ ID NO: 5355 - DNA, 1251 bp, Artificial Sequence
  Description of Artificial Sequence: Synthetic Construct
atggcagaaaatcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagaaattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5356 - protein, 416 aa, Artificial Sequence
  Description of Artificial Sequence: Synthetic Construct
MAENRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKKLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5357 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtcgctgcacttttaggaggtcagcagttggctttagagcctcccgacttagaacgcaaagaacgcaggagcgataagaactaa

SEQ ID NO: 5358 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALLGGQQLALEPPDLERKERRSDKN

SEQ ID NO: 5359 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagcgattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttatctctcagtccccacgacatgtggttcttcgcaattatgaaggtgttatcacaacctatacggagccggaggactatcatgaggagtgcgattgtgaggactgccgagtcgacaagcatcgtgagggcgtcgctgcacttttaggaggtcagcagttggctttagagcctcccgacttagaacgcaaagaacgcaggagcgataagaactaa

SEQ ID NO: 5360 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVISQSPRHVVLRNYEGVITTYTEPEDYHEECDCEDCRVDKHREGVAALLGGQQLALEPPDLERKERRSDKN

SEQ ID NO: 5361 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtattggcgtggctgcactttccggaggtcagcagttggctttagtgcctcccgacttagctcgcaaagaacgcaggagcgataagaactaa

SEQ ID NO: 5362 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHRIGVAALSGGQQLALVPPDLARKERRSDKN

SEQ ID NO: 5363 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaatttcgaaggtgttatcacaacctatacggagccggaggactatcatgaggagtgcgattgtgaggactgccgagtcgacaagcatcgtgagggcgtggctgcactttccagcggtcagcagttggctttagagcctcccgacttagctcgcaaagaacgcaggagcgataagaactaa

SEQ ID NO: 5364 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNFEGVITTYTEPEDYHEECDCEDCRVDKHREGVAALSSGQQLALEPPDLARKERRSDKN

SEQ ID NO: 5365 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtctgcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacccgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5366 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVCDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5367 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaggaagaagagggagtaaaagaatcgcccaaagtactccgaatggctatcacgccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggatgactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5368 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPDDYHEECDCEDCRVDKHREGVAALSGGQQLALEPPDLARKERRSDKN

SEQ ID NO: 5369 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgacctgctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccagcggtcagcagttggctttagagcctcccgacttagctcgcaaagaacgcaggagcgataagaactaa

SEQ ID NO: 5370 - protein, 416 aa, Artificial Sequence
  Description of Artificial Sequence: Synthetic Construct
MAESRRKHYFPDVTDEQWYDWHWQVINRIKTLDLLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSSGQQLALEPPDLARKERRSDKN

SEQ ID NO: 5371 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatctccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5372 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHLRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5373 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattcgtacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacggcatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5374 - protein, 416 aa, Artificial Sequence; identical to SEQ ID NO: 4664
  Description of Artificial Sequence: Synthetic Construct

SEQ ID NO: 5375 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaataagccatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggatgactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5376 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGISHFRTPVSKGIEIIENLRGHTSGYAVPTFVVHAPGGGGKIPVAPNYVVSQSPRHVVLRNYEGVITTYTEPDDYHEECDCEDCRVDKHREGVAALSGGQQLALEPPDLARKERRSDKN

SEQ ID NO: 5377 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaacgggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggatgactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5378 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRERVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPDDYHEECDCEDCRVDKHREGVAALSGGQQLALEPPDLARKERRSDKN

SEQ ID NO: 5379 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaataagccatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaatttcgaaggtgttatcacaacctatacggagccggaggactatcatgaggagtgcgattgtgaggactgccgagtcgacaagcatcgtattggcgtggctgcactttccggaggtcagcagttggctttagagcctcccgacttagctcgcaaagaacgcaggagcgataagaactaa

SEQ ID NO: 5380 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGISHFRTPVSKGIEIIENLRGHTSGYAVPTFVVHAPGGGGKIPVAPNYVVSQSPRHVVLRNFEGVITTYTEPEDYHEECDCEDCRVDKHRIGVAALSGGQQLALEPPDLARKERRSDKN

SEQ ID NO: 5381 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaataagccatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtattggcgtggctgcactttccggaggtcagcagttggctttagagcctcccgacttagctcgcaaagaacgcaggagcgataagaactaa

SEQ ID NO: 5382 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGISHFRTPVSKGIEIIENLRGHTSGYAVPTFVVHAPGGGGKIPVAPNYVVSQSPRHVVLRNYEGVITTYTEPEDYHEECDCEDCRVDKHRIGVAALSGGQQLALEPPDLARKERRSDKN

SEQ ID NO: 5383 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtattggcgtggctgcactttccagcggtcagcagttggctttagtgcctcccgacttagctcgcaaagaacgcaggagcgataagaactaa

SEQ ID NO: 5384 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHRIGVAALSSGQQLALVPPDLARKERRSDKN

SEQ ID NO: 5385 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaataagccatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaatttcgaaggtgttatcacaacctatacggagccggatgactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5386 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGISHFRTPVSKGIEIIENLRGHTSGYAVPTFVVHAPGGGGKIPVAPNYVVSQSPRHVVLRNFEGVITTYTEPDDYHEECDCEDCRVDKHREGVAALSGGQQLALEPPDLARKERRSDKN

SEQ ID NO: 5387 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgacctgctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggatgactatcatgaggagtgcgattgtgaggactgccgagtcgacaagcatcgtgagggcgtggctgcactttccggaggtcagcagttggctttagtgcctcccgacttagctcgcaaagaacgcaggagcgataagaactaa

SEQ ID NO: 5388 - protein, 416 aa, Artificial Sequence
  Description of Artificial Sequence: Synthetic Construct
MAESRRKHYFPDVTDEQWYDWHWQVINRIKTLDLLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPDDYHEECDCEDCRVDKHREGVAALSGGQQLALVPPDLARKERRSDKN

SEQ ID NO: 5389 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgctttgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5390 - protein, 416 aa, Artificial Sequence; identical to SEQ ID NO: 3260
  Description of Artificial Sequence: Synthetic Construct

SEQ ID NO: 5391 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaatgatccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaataagccatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaagtcaacagttggctttagagcctcccgacttagctcgcaaagaacgcaggagcgataagaactaa

SEQ ID NO: 5392 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNDPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGISHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGSQQLALEPPDLARKERRSDKN

SEQ ID NO: 5393 - DNA, 1251 bp, Artificial Sequence
  Description of Artificial Sequence: Synthetic Construct
atggcagaaagtcgtagaaagcattatttccccgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggaccgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggatgactatcatgaggagtgcgattgtgaggactgccgagtcgacaagcagcgtattggcgtggctgcactttccagcggtcagcagttggctttagtgcctcccgacttagctcgcaaggaacgcaggagcgataagaactaa

SEQ ID NO: 5394 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPDDYHEECDCEDCRVDKQRIGVAALSSGQQLALVPPDLARKERRSDKN

SEQ ID NO: 5395 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaataagccatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5396 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGISHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5397 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaataagccatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaggaacgcaggagcgataagaactaa

SEQ ID NO: 5398 - protein, 416 aa, Artificial Sequence; identical to SEQ ID NO: 5396
  Description of Artificial Sequence: Synthetic Construct

SEQ ID NO: 5399 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatgcctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5400 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKMPVAPNYVVSQSPRHVVLRNYEGVITTYTEPEDYHEECDCEDCRVDKHREGVAALSGGQQLALEPPDLARKERRSDKN

SEQ ID NO: 5401 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagtgcctcccgacttagctcgcaaagaacgcaggagcgataagaactaa

SEQ ID NO: 5402 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALVPPDLARKERRSDKN

SEQ ID NO: 5403 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggatgactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5404 - protein, 416 aa, Artificial Sequence; identical to SEQ ID NO: 5368
  Description of Artificial Sequence: Synthetic Construct

SEQ ID NO: 5405 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacgtgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtattggcgtggctgcactttccagcggtcagcagttggctttagagcctcccgacttagctcgcaaagaacgcaggagcgataagaactaa

SEQ ID NO: 5406 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTRVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHRIGVAALSSGQQLALEPPDLARKERRSDKN

SEQ ID NO: 5407 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaatgatccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaagaacgcaggagcgataagaactaa

SEQ ID NO: 5408 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNDPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5409 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaataagccatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtattggcgtggctgcactttccagcggtcagcagttggctttagagcctcccgacttagctcgcaaagaacgcaggagcgataagaactaa

SEQ ID NO: 5410 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGISHFRTPVSKGIEIIENLRGHTSGYAVPTFVVHAPGGGGKIPVAPNYVVSQSPRHVVLRNYEGVITTYTEPEDYHEECDCEDCRVDKHRIGVAALSSGQQLALEPPDLARKERRSDKN

SEQ ID NO: 5411 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggatgactatcatgaggagtgcgattgtgaggactgccgagtcgacaagcatcgtattggcgtggctgcactttccggaggtcagcagttggctttagagcctcccgacttagctcgcaaggaacgcaggagcgataagaactaa

SEQ ID NO: 5412 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPDDYHEECDCEDCRVDKHRIGVAALSGGQQLALEPPDLARKERRSDKN

SEQ ID NO: 5413 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaatagggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaatttcgaaggtgttatcacaacctatacggagccggaggactatcatgaggagtgcgattgtgaggactgccgagtcgacaagcatcgtgagggcgtggctgcactttccggaggtcagcagttggctttagtgcctcccgacttagctcgcatggaacgcaggagcgataagaactaa

SEQ ID NO: 5414 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNFEGVITTYTEPEDYHEECDCEDCRVDKHREGVAALSGGQQLALVPPDLARMERRSDKN

SEQ ID NO: 5415 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaataaggcatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtgagggcgtggctgcactttccggaggtcagcagttggctttagagcctcccgacttagctcgcaaggaacgcaggagcgataagaactaa

SEQ ID NO: 5416 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIRHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5417 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaataagccatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggatgactatcatgaggagtgcgattgtgaggactgccgagtcgacaagcatcgtgagggcgtggctgcactttccggaggtcagcagttggctttagagcctcccgacttagctcgcatggaacgcaggagcgataagaactaa

SEQ ID NO: 5418 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGISHFRTPVSKGIEIIENLRGHTSGYAVPTFVVHAPGGGGKIPVAPNYVVSQSPRHVVLRNYEGVITTYTEPDDYHEECDCEDCRVDKHREGVAALSGGQQLALEPPDLARMERRSDKN

SEQ ID NO: 5419 - DNA, 1251 bp, Artificial Sequence
  Description of Artificial Sequence: Synthetic Construct
atggcagaaagtcgtagaaagcattatttccctgatgtcaccgatgagcaatggtacgactggcattggcaggtcatcaatcgaattaagacgctcgaccagctggagaagtacgttacactcaccgctgaagaagaagagggagtaaaagaatcgcccaaagtactccgaatggctatcacaccttattatttgagtttgatagaccccgagaatcctaattgtccgattcgtaaacaagccattcctactaaacgggaactggtacgtgctcctgaagatatggtagacccacttagtgaagatgaagattcgcccgtacccggactgactcatcgttatccggatcgtgtattgttccttatcacggacaaatgttcgatgtactgtcgtcattgtactcgccgtcgcttcgcaggacagagagatgcttcttctccttctgagcgcatcgatcgatgcattgagtatatagccaatacaccgacagtccgcgatgttttgctatcgggaggcgatgccctccttgtcagcgacgaacgcttggaatacatattgaagcgtctgcgcgaagtacctcatgtggagattgttcgtataggaagccgtgcgccggtagtcctccctcagcgtataacgcctcaattggtggatatgctcaaaaaatatcatccggtgtggctgaacactcacttcaaccacccgaatgaagttaccgaagaagcagtggaggcttgtgaaagaatggccaatgccggtattccgttgggtaaccaaacggttttattgcgtggaatcaatgattgtacacatgtgatgaagagattggtacatttgctggtaaagattcgtgtgcgtccttactatatatatgcttgcgatctttcgcttggaataagccatttccgcacgccggtatctaagggaatcgaaattatcgaaaatttgcgcggacacacctcgggctatgcagttcctacctttgtggtacatgctccggggggtggtggtaagatacctgtagcgccgaactatgttgtatctcagtccccacgacatgtggttcttcgcaattatgaaggtgttatcacaacctatacggagccggaggactatcatgaggagtgcgattgtgaggactgccgagtcgacaagcatcgtattggcgtggctgcactttccggaggtcagcagttggctttagtgcctcccgacttagctcgcaaagaacgcaggagcgataagaactaa

SEQ ID NO: 5420 - protein, 416 aa, Artificial Sequence
  Description of Artificial Sequence: Synthetic Construct
MAESRRKHYFPDVTDEQWYDWHWQVINRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGISHFRTPVSKGIEIIENLRGHTSGYAVPTFVVHAPGGGGKIPVAPNYVVSQSPRHVVLRNYEGVITTYTEPEDYHEECDCEDCRVDKHRIGVAALSGGQQLALVPPDLARKERRSDKN

SEQ ID NO: 5421 - protein, 21 aa, Artificial Sequence
  Description of Artificial Sequence: Synthetic Construct
GQQLALEPPDLARKKRRSDKN

SEQ ID NO: 5422 - protein, 189 aa, Artificial Sequence
  Description of Artificial Sequence: Synthetic Construct
LNTHFNHPNEVTEEAVGACERMANAGIPLGNQTVLLRGINGCTHVMKRLVHLLVKIRVRPYYIYACDLSLGIGHFRTPISKGIEIIENLRGHTSGYAVPTFVVHAPGGGGKIPVAPNYVVSQSPRHVVLRNYEGVITTYTEPEDYHEECDCEDCRVDKHREGVATLSGGQQLALEPPDLARKKRRSDKN

SEQ ID NO: 5423 - protein, 259 aa, Artificial Sequence
  Description of Artificial Sequence: Synthetic Construct
IANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVTTTYTEPEDYHGECDCEDCRVDKHREGVAALSGGQQLALEPPDLARKKRRSDKN

SEQ ID NO: 5424 - protein, 21 aa, Artificial Sequence
  Description of Artificial Sequence: Synthetic Construct
GQQLALEPPDLARKERRSDKN

SEQ ID NO: 5425 - protein, 160 aa, Artificial Sequence
  Description of Artificial Sequence: Synthetic Construct
GNQTVLLRGINDCTHVMKRLVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5426 - protein, 398 aa, Artificial Sequence
  Description of Artificial Sequence: Synthetic Construct
YDWRWQVINRIKTLDLLEKYVTLTVEEEEGVKESPKVLRVAITPYYLSLIDPENPNCPICKQAIPTKRELVRAPEDMVDPLSEDEDSPVPGLTHRYPDRVLFLITDKCSMYCRHCTRRRLAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYIYACDLSLGISHFRTPVSKGIEIIENLRGHTSGYAVPTFVVHAPGGGGKIPVAPNYVVSQSPRHVVLRNFEGVITTYTEPDDYHEECDCEDCRVDKHREGVAALSGGQQLALVPPDLARKERRSDKN

SEQ ID NO: 5427 - protein, 409 aa, Artificial Sequence
  Description of Artificial Sequence: Synthetic Construct
HYLPDVTDEQSYDWHWHVINRNKTLDQLEKYVTLTVEEEEGVKESPKVLRMAITPYYLSLIDPENPNCPIRKQAIPTKRELVRAPEDMVDPLSEDEDSPVPGLTHRYPDRVLFLITDKCSMYCRHCTRRRFAGQRDASSPSERIDRCIEYIANTPTVRDVLLSGGDALLVNDERLEYILKRLREVPHVEIIRIGSRAPVVLPQRITPQLVDMLKKYHPVWLNTHFNHPNEVTEEAVEACERMANAGIPLGNQTVLLRGINDCTHVMKRLVHLLVNIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5428 - protein, 409 aa, Artificial Sequence
  Description of Artificial Sequence: Synthetic Construct
RYFPDVTDEQSYDWHWQDLNRIKTLDQLEKYVTLTAEEEEGVKESPKVLRMAITPYYLSLIDPENPNCPIRKQAIPTKRELVRAPEDMVDPLSEDEDSPVPGLTHRYPDRVLFLITDKCSMYCRHCTRCRFAGQRDASSPSERIDRCIEYIANTPTVRDVLLSGGDALLVSDERLEYILKRLREVPHVEIVRIGSRAPVVLPQRITPQLVDMLKKYHPVWLNTHFNHPNEVTEEAVEACERMANAGIPLGNQTVLLRGINDCTHVMKRLVHLLVKIRVRPYYLYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5429 - protein, 141 aa, Artificial Sequence
  Description of Artificial Sequence: Synthetic Construct
LVHLLVKIRVRPYYIYACDLSLGIGHFRTPVSKGIEIIENLRGHTSGYAVPTFVVHAPGGGGKIPVAPNYVVSQSPRHVVLRNYEGVITTYTEPEDYHEECDCEDCRVDKHREGVAALSGGQQLALEPPDLARKERRSDKN

SEQ ID NO: 5430 - protein, 6 aa, Artificial Sequence
  Description of Artificial Sequence: Synthetic 6xHis tag
HHHHHH
